(12) United States Patent
Bedoya et al.

(10) Patent No.: US 10,829,735 B2
(45) Date of Patent: Nov. 10, 2020

(54) METHODS FOR IMPROVING THE EFFICACY AND EXPANSION OF IMMUNE CELLS

(71) Applicants: The Trustees of the University of Pennsylvania, Philadelphia, PA (US); Novartis AG, Basel (CH)

(72) Inventors: Felipe Bedoya, East Norristown, PA (US); Saba Ghassemi, Philadelphia, PA (US); Carl H. June, Merion Station, PA (US); Omkar U. Kawalekar, Philadelphia, PA (US); Bruce L. Levine, Cherry Hill, NJ (US); Jan J. Melenhorst, Cherry Hill, NJ (US); Michael Milone, Cherry Hill, NJ (US); Daniel J. Powell, Jr., Bala Cynwyd, PA (US); Zoe Zheng, Cherry Hill, NJ (US)

(73) Assignees: The Trustees of the University of Pennsylvania, Philadelphia, PA (US); Novartis AG, Basel (CH)

( * ) Notice: Subject to any disclaimer, the term of this patent is extended or adjusted under 35 U.S.C. 154(b) by 0 days.

(21) Appl. No.: 15/216,036

(22) Filed: Jul. 21, 2016

(65) Prior Publication Data
US 2017/0137783 A1    May 18, 2017

Related U.S. Application Data

(60) Provisional application No. 62/195,056, filed on Jul. 21, 2015.

(51) Int. Cl.
| | | |
|---|---|---|
| C12N 5/0783 | (2010.01) | |
| C07K 16/30 | (2006.01) | |
| C07K 14/725 | (2006.01) | |
| C07K 14/705 | (2006.01) | |
| A61K 35/17 | (2015.01) | |
| C07K 16/18 | (2006.01) | |
| C07K 16/28 | (2006.01) | |
| C12N 5/00 | (2006.01) | |

(52) U.S. Cl.
CPC ............ *C12N 5/0636* (2013.01); *A61K 35/17* (2013.01); *C07K 14/705* (2013.01); *C07K 14/7051* (2013.01); *C07K 14/70517* (2013.01); *C07K 14/70578* (2013.01); *C07K 16/18* (2013.01); *C07K 16/28* (2013.01); *C07K 16/2803* (2013.01); *C07K 16/30* (2013.01); *C12N 5/0087* (2013.01); *C07K 2317/622* (2013.01); *C07K 2319/03* (2013.01); *C07K 2319/33* (2013.01); *C07K 2319/74* (2013.01); *C12N 2501/2302* (2013.01); *C12N 2501/2307* (2013.01); *C12N 2501/2315* (2013.01); *C12N 2501/50* (2013.01); *C12N 2510/00* (2013.01); *C12N 2740/16043* (2013.01)

(58) Field of Classification Search
None
See application file for complete search history.

(56) References Cited

U.S. PATENT DOCUMENTS

| | | |
|---|---|---|
| 5,359,046 A | 10/1994 | Capon et al. |
| 5,686,281 A | 11/1997 | Roberts |
| 5,712,149 A | 1/1998 | Roberts |
| 5,874,240 A | 2/1999 | Ni et al. |
| 5,906,936 A | 5/1999 | Eshhar et al. |
| 6,103,521 A | 8/2000 | Capon et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |
| 6,475,481 B2 | 11/2002 | Talmadge |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,265,209 B2 | 9/2007 | Jensen |
| 7,319,143 B2 | 1/2008 | Gross et al. |
| 7,320,787 B2 | 1/2008 | Seed et al. |
| 7,446,190 B2 | 11/2008 | Sadelain et al. |
| 7,446,191 B2 | 11/2008 | Jensen |
| 7,514,537 B2 | 4/2009 | Jensen |
| 7,638,326 B2 | 12/2009 | June et al. |
| 7,741,465 B1 | 6/2010 | Eshhar et al. |
| 7,745,140 B2 | 6/2010 | June et al. |
| 7,754,482 B2 | 7/2010 | Riley et al. |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |

(Continued)

FOREIGN PATENT DOCUMENTS

| | | |
|---|---|---|
| CN | 105158466 A | 12/2015 |
| EP | 0574512 A1 | 12/1993 |

(Continued)

OTHER PUBLICATIONS

Almagro & Fransson, Frontiers in Bioscience 2008; 13:1619-33 (Year: 2008).*
Rudikoff et al. (PNAS, USA, 1982, 79: 1979-1983) (Year: 1982).*
Abaza et al. (Journal of Protein Chemistry, vol. 11, No. 5, 1992, pp. 433-444) (Year: 1992).*
Coleman et al. (Research in Immunology, 1994; 145(1): 33-36) (Year: 1994).*
Jena et al. (PLOS ONE Mar. 2013, 8 (3): e57838) (Year: 2013).*
Taylor et al. (Mol. Immunology 2009 46: 622-629) (Year: 2009).*
Kmieciak et al. ((2011) JoVE. 47. http://www.jove.com/details.php?id=2381, doi: 10.3791/2381) (Year: 2011).*

(Continued)

*Primary Examiner* — Peter J Reddig
(74) *Attorney, Agent, or Firm* — Lando & Anastasi, LLP

(57) ABSTRACT

The invention provides methods of making immune effector cells (e.g., T cells, NK cells) that can be engineered to express a chimeric antigen receptor (CAR), compositions and reaction mixtures comprising the same, and methods of treatment using the same.

28 Claims, 64 Drawing Sheets

Specification includes a Sequence Listing.

(56) References Cited

U.S. PATENT DOCUMENTS

| | | |
|---|---|---|
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,272,002 B2 * | 3/2016 | Powell, Jr. ......... C07K 14/7051 |
| 9,328,156 B2 * | 5/2016 | June ...................... A61K 35/17 |
| 9,365,641 B2 * | 6/2016 | June ...................... C07K 16/18 |
| 9,394,368 B2 * | 7/2016 | Brogdon ............... A61K 38/00 |
| 9,402,865 B2 * | 8/2016 | Powell ................... A61K 35/17 |
| 9,422,351 B2 * | 8/2016 | Scholler ............. C07K 16/2827 |
| 9,446,105 B2 * | 9/2016 | Powell, Jr. ......... C07K 14/7051 |
| 9,464,140 B2 * | 10/2016 | June ...................... A61K 35/17 |
| 9,481,728 B2 * | 11/2016 | June ...................... A61K 35/17 |
| 9,499,629 B2 * | 11/2016 | June ...................... A61K 35/17 |
| 9,518,123 B2 * | 12/2016 | June ...................... A61K 35/17 |
| 9,540,445 B2 * | 1/2017 | June ...................... A61K 35/17 |
| 9,572,836 B2 * | 2/2017 | June ...................... G01N 33/92 |
| 9,573,988 B2 * | 2/2017 | Brogdon .......... C07K 14/70517 |
| 9,598,489 B2 * | 3/2017 | Powell, Jr. ............. C07K 16/28 |
| 9,708,384 B2 * | 7/2017 | Scholler ............... C07K 14/465 |
| 9,714,278 B2 * | 7/2017 | June ...................... C07K 14/705 |
| 9,745,368 B2 | 8/2017 | Milone et al. |
| 9,765,156 B2 * | 9/2017 | June ...................... C07K 16/468 |
| 9,777,061 B2 | 10/2017 | Ebersbach et al. |
| 9,815,901 B2 * | 11/2017 | Brogdon ............ C07K 16/2866 |
| 2003/0060444 A1 | 3/2003 | Finney et al. |
| 2003/0077249 A1 | 4/2003 | Bebbington et al. |
| 2003/0105000 A1 * | 6/2003 | Pero ........................ A61K 38/06 |
| | | 514/19.3 |
| 2003/0148982 A1 | 8/2003 | Brenner et al. |
| 2003/0224520 A1 | 12/2003 | June et al. |
| 2004/0038886 A1 | 2/2004 | Finney et al. |
| 2004/0043401 A1 | 3/2004 | Sadelain et al. |
| 2005/0113564 A1 | 5/2005 | Campana et al. |
| 2005/0129671 A1 | 6/2005 | Cooper et al. |
| 2007/0036773 A1 | 2/2007 | Cooper et al. |
| 2008/0131415 A1 | 6/2008 | Riddell et al. |
| 2008/0160090 A1 | 7/2008 | Oraevsky et al. |
| 2009/0257994 A1 | 10/2009 | Jensen |
| 2011/0052554 A1 | 3/2011 | Zakrzewski et al. |
| 2012/0027802 A1 | 2/2012 | Bonini et al. |
| 2012/0148552 A1 | 6/2012 | Jensen |
| 2012/0302466 A1 * | 11/2012 | Sentman ............... C12N 5/0636 |
| | | 506/23 |
| 2012/0321667 A1 | 12/2012 | Sentman |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0287748 A1 | 10/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0370045 A1 | 12/2014 | June et al. |
| 2015/0017141 A1 | 1/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0260268 A1 | 9/2017 | Beatty et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |
| 2018/0044424 A1 | 2/2018 | June et al. |
| 2018/0118834 A1 | 5/2018 | Brogdon et al. |
| 2018/0125892 A1 | 5/2018 | Brannetti et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0252727 A1 | 9/2018 | Garfall et al. |
| 2018/0258149 A1 | 9/2018 | Motz et al. |
| 2018/0298068 A1 | 10/2018 | Albelda |
| 2018/0312595 A1 | 11/2018 | Brogdon et al. |
| 2019/0000880 A1 | 1/2019 | Motz et al. |
| 2019/0000944 A1 | 1/2019 | Brogdon et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |
| 2019/0263914 A1 | 8/2019 | Brogdon et al. |
| 2019/0269727 A1 | 9/2019 | Fachin et al. |
| 2019/0292238 A1 | 9/2019 | Bitter et al. |
| 2019/0292257 A1 | 9/2019 | Bedoya et al. |
| 2019/0298715 A1 | 10/2019 | Motz et al. |
| 2019/0330356 A1 | 10/2019 | Brogdon et al. |
| 2019/0336504 A1 | 11/2019 | Gill et al. |
| 2019/0375815 A1 | 12/2019 | Engels et al. |
| 2019/0382500 A1 | 12/2019 | Abujoub et al. |
| 2019/0388471 A1 | 12/2019 | June et al. |
| 2019/0389928 A1 | 12/2019 | Posey et al. |
| 2020/0048359 A1 | 2/2020 | Albelda et al. |
| 2020/0055948 A1 | 2/2020 | Daley et al. |
| 2020/0061113 A1 | 2/2020 | Kassim et al. |
| 2020/0085869 A1 | 3/2020 | Schuster et al. |
| 2020/0087376 A1 | 3/2020 | Fraietta et al. |

FOREIGN PATENT DOCUMENTS

| | | |
|---|---|---|
| EP | 0871495 A1 | 10/1998 |
| EP | 1226244 A2 | 7/2002 |
| EP | 1955708 A1 | 8/2008 |
| WO | 1992015322 A1 | 9/1992 |
| WO | 199530014 A1 | 11/1995 |
| WO | 9623814 A1 | 8/1996 |
| WO | 9624671 A1 | 8/1996 |
| WO | 1997015669 A1 | 5/1997 |
| WO | 9723613 A2 | 7/1997 |
| WO | 9818809 A1 | 5/1998 |
| WO | 9900494 A2 | 1/1999 |
| WO | 9957268 A1 | 11/1999 |
| WO | 0014257 A1 | 3/2000 |
| WO | 2002033101 A1 | 4/2002 |
| WO | 02077029 A2 | 10/2002 |
| WO | 02088334 A1 | 11/2002 |
| WO | 2003057171 A2 | 7/2003 |
| WO | 2005019429 A2 | 3/2005 |
| WO | 2005044996 A2 | 5/2005 |

(56) References Cited

FOREIGN PATENT DOCUMENTS

| WO | 2005/118788 A2 | 12/2005 | | |
|---|---|---|---|---|
| WO | 2006060878 A1 | 6/2006 | | |
| WO | 2008045437 A2 | 4/2008 | | |
| WO | 2010085660 A2 | 7/2010 | | |
| WO | 2011059836 A2 | 5/2011 | | |
| WO | 2011097477 A1 | 8/2011 | | |
| WO | 2012058460 A2 | 5/2012 | | |
| WO | 2012079000 A1 | 6/2012 | | |
| WO | 2012082841 A2 | 6/2012 | | |
| WO | 2012/099973 A2 | 7/2012 | | |
| WO | 2012127464 A2 | 9/2012 | | |
| WO | 2012129514 A1 | 9/2012 | | |
| WO | 2012135854 A2 | 10/2012 | | |
| WO | 2012138858 A1 | 10/2012 | | |
| WO | 2013019615 A2 | 2/2013 | | |
| WO | 2013033626 A2 | 3/2013 | | |
| WO | 2013040371 A2 | 3/2013 | | |
| WO | 2013040557 A2 | 3/2013 | | |
| WO | 2013059593 A1 | 4/2013 | | |
| WO | WO-2013074916 A1 * | 5/2013 | ......... | A61K 39/0011 |
| WO | 2013/126712 A1 | 8/2013 | | |
| WO | 2013126729 A1 | 8/2013 | | |
| WO | 2013126733 A1 | 8/2013 | | |
| WO | 2014/011984 A1 | 1/2014 | | |
| WO | 2014/011987 A1 | 1/2014 | | |
| WO | 2014/011993 A2 | 1/2014 | | |
| WO | 2014/012001 A2 | 1/2014 | | |
| WO | 2014011988 A2 | 1/2014 | | |
| WO | 2014011996 A1 | 1/2014 | | |
| WO | 2014031687 A1 | 2/2014 | | |
| WO | 2014039513 A2 | 3/2014 | | |
| WO | 2014/055442 A2 | 4/2014 | | |
| WO | 2014/055771 A1 | 4/2014 | | |
| WO | 2014055657 A1 | 4/2014 | | |
| WO | 2014055668 A1 | 4/2014 | | |
| WO | 2014124134 A1 | 8/2014 | | |
| WO | 2014/130635 A1 | 8/2014 | | |
| WO | 2014/145252 A2 | 9/2014 | | |
| WO | 2014138704 A1 | 9/2014 | | |
| WO | WO-2014190273 A1 * | 11/2014 | ......... | C07K 16/2803 |
| WO | 2015090229 A1 | 6/2015 | | |
| WO | 2015090230 A1 | 6/2015 | | |
| WO | 2015112626 A1 | 7/2015 | | |
| WO | 2015/142661 A1 | 9/2015 | | |
| WO | 2015142675 A2 | 9/2015 | | |
| WO | 2015157252 A1 | 10/2015 | | |
| WO | 2015164745 A1 | 10/2015 | | |
| WO | 2016014501 A1 | 1/2016 | | |
| WO | 2016014530 A1 | 1/2016 | | |
| WO | 2016014535 A1 | 1/2016 | | |
| WO | 2016014553 A1 | 1/2016 | | |
| WO | 2016014565 A2 | 1/2016 | | |
| WO | 2016014576 A1 | 1/2016 | | |
| WO | 2016019300 A1 | 2/2016 | | |
| WO | 2016025880 A1 | 2/2016 | | |
| WO | 2016028896 A1 | 2/2016 | | |
| WO | 2016044605 A1 | 3/2016 | | |
| WO | 2016/057705 A1 | 4/2016 | | |
| WO | 2016/109410 A2 | 7/2016 | | |
| WO | 2016/168595 A1 | 10/2016 | | |
| WO | 2017117112 A1 | 7/2017 | | |

OTHER PUBLICATIONS

Partial International Search Report for International Application No. PCT/US2016/068683 dated Apr. 18, 2017.
Priceman et al., "Smart CARs Engineered for Cancer Immunotherapy" Curr Opin Oncol (2015) vol. 27, No. 6, pp. 466-474.
Wang et al. "CS-1 Re-Directed Central Memory T Cell Therapy for Multiple Myeloma" Blood (2014) vol. 124, No. 21, Meeting Abstract 1114.
Zhang et al. "Efficiency of CD19 chimeric antigen receptor-modified T cells for treatment of B cell malignancies in phase I clinical trials: a meta analysis" Oncotarget (2015) vol. 6, No. 32, pp. 33961-33971.
Baeksgaard & Sorensen, "Acute tumor lysis syndrome in solid tumors—a case report and review of the literature" Cancer Chemotherapy Pharmacology (2003) vol. 51 pp. 187-192.
Barrett et al. "Relation of clinical culture method to T-cell memory status and efficacy in xenograft models of adoptive immunotherapy", Cytotherapy (2014) vol. 16, No. 5, pp. 619-630.
Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor-Chain alone Are Insufficient to Prime Resting T Lymphocytes" J. Exp. Med. (1995) vol. 181 pp. 1653-1659.
Call & Wucherpfennig, "The T Cell Receptor: Critical Role of the Membrane Environment in Receptor Assembly and Function" Annu. Rev. Immunol. (2005) vol. 23 pp. 101-125.
Carpenito et al. "Control of large, established tumor xenografts with genetically retargeted human T cells containing CD28 and CD137 domains", Proc Natl Acad Sci USA (2009) vol. 106 pp. 3360-3365.
Cha et al. "IL-7 + IL-15 are superior to IL-2 for the ex vivo expansion of 4T1 mammary carcinoma-specific T cells with greater efficacy against tumors in vivo", Breast Cancer Research and Treatment, Kluwer Academic Publishers (2009) vol. 122, No. 2, pp. 359-369.
Cheadle et al. "CAR T cells: driving the road from the laboratory to the clinic", Immunological Reviews (2013), vol. 257, No. 1, pp. 91-106.
Davila et al. "B Cell Aplasia in a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dotti et al. "Design and development of therapies using chimeric antigen receptor-expressing T cells" Immunological Reviews (2013) vol. 257, No. 1, pp. 107-126.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al, "A Third-Generation Lentivirus Vector with a Conditional Packaging System" Journal of Virology (1998) vol. 72 No. 11 pp. 8463-8471.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).

(56) References Cited

OTHER PUBLICATIONS

Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Flynn et al. "Stem memory T cells (TSCM)—their role in cancer and HIV immunotherapies", Clinical & Translational Immunology (2014) vol. 3, No. 7, pp. 1-7.
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093 (2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Hekele et al., "Growth Retardation of Tumors by Adoptive Transfer of Cytotoxic T Lymphocytes Reprogrammed by CD44V6-Specific SCFV:—Chimera" Int J. Cancer (1996) vol. 68 pp. 232-238.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Hosing et al. "CARs in Chronic Lymphocytic Leukemia—Ready to Drive", Current Hematologic Malignancy Reports (2012) vol. 8, No. 1, pp. 60-70.

Imai et al., "Chimeric receptors with 4-1BB signaling capacity provoke potent cytotoxicity against acute lymphoblastic leukemia," Leukemia 18: 676-684 (2004).
Imai et al., "Genetic modification of primary natural killer cells overcomes inhibitory signals and induces specific killing of leukemic cells" Blood (2005) vol. 106 No. 1 pp. 376-383.
International Search Report and Written Opinion for International Application No. PCT/US2015/067635 dated Apr. 19, 2016.
International Search Report and Written Opinion for International Application No. PCT/US2016/043255 dated Dec. 16, 2016.
International Search Report and Written Opinion from International Application No. PCT/US2016/027751 dated Jan. 7, 2016.
International Search Report from PCT/US2011/064191 dated Jan. 5, 2012.
Irving et al., "The cytoplasmic domain of the T cell receptor zeta chain is sufficient to couple to receptor-associated signal transduction pathways," Cell 64: 891-901 (1991).
Jena, Bipulendu et al. "Redirecting T-cell specificity by introducing a tumor-specific chimeric antigen receptor, Blood, May 3, 2010", vol. 116, No. 7, pp. 1035-1044.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Singh et al. "Early memory phenotypes drive T cell proliferation in patients with pediatric malignancies", Science Translational Medicine (2012) vol. 8, No. 320, pp. 320ra3-320ra3.
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Stroncek et al. "Highlights of the society for immunotherapy of cancer (SITC) 27th annual meeting" Journal for ImmunoTherapy of Cancer (2013) vol. 1, No. 4, pp. 1-11.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Vinay & Kwon, "Role of 4-1BB in immune responses" Immunology (1998) vol. 10 pp. 481-489.
Willemsen et al., "Genetic Engineering of T Cell Specificity for Immunotherapy of Cancer" Human Immunology (2003) vol. 64 pp. 56-68.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Johnson et al., "Gene therapy with human and mouse T-cell receptors mediates cancer regression and targets normal tissues expressing cognate antigen" Blood (2009) vol. 114 No. 3 pp. 535-545.
Jones et al., "Circulating clonotypic B cells in classic Hodgkin lymphoma." Blood (2009) vol. 113 No. 23 pp. 5920-5926.
Joo et al., "Targeted cancer therapy—are the days of systemic chemotherapy numbered?" Maturitas (2013) vol. 76 No. 4 pp. 308-314.
June et al., "Engineering lymphocyte subsets: tools, trials and tribulations" Nat Rev Immunol (2009) vol. 9 No. 10 pp. 704-716.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kershaw et al., "A Phase I Study on Adoptive Immunotherapy Using Gene-Modified T Cells for Ovarian Cancer," Clin. Cancer Res. 12(20 Pt 1): 6106-6115 (2006).

(56) References Cited

OTHER PUBLICATIONS

Kim et al., "Human 4-1BB regulates CD28 co-stimulation to promote Th1 cell responses" Eur. J. Immunol. (1998) vol. 28 pp. 881-890.
Kochenderfer et al, "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-of-Hematology (ASH), Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 389-702.
Kochenderfer et al., "Eradication of B-lineage cells and regression of lymphoma in a patient treated with autologous T cells genetically-engineered to recognize CD19," Blood 116: 4099-4102 (2010).
Koehler et al. "Engineered T Cells for the Adoptive Therapy of B-Cell Chronic Lymphocytic Leukaemia", Advances in Hematology (2012) vol. 180, No. 9, pp. 6365-13.
Kohn et al. "CARs on Track in the Clinic", Molecular Therapy (2011) vol. 19, No. 3, pp. 432-438.
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kwon et al., "cDNA sequences of two inducible T-cell genes". Proc. Natl. Acad. Sci. U.S.A. 86(6): 1963-1967 (1989).
Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Lipowska-Bhalla et al. "Targeted immunotherapy of cancer with CAR T cells: achievements and challenges", (Cancer Immunology Immunotherapy 2012) vol. 61 pp. 953-962.
Macallan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).
McGuinness et al., "Anti-tumor activity of human T cells expressing the CC49-zeta chimeric immune receptor," Hum. Gene Ther. 10: 165-173 (1999).
Milone et al, "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Molina, "A Decade of Rituximab: Improving Survival Outcomes in Non-Hodgkin's Lymphoma" Annu. Rev. Med. (2008) vol. 59 pp. 237-250.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(16-17): 1157-1165 (1997).
Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.
Patel et al., "Impact of chimeric immune receptor extracellular protein domains on T cell function" Gene Therapy (1999) vol. 6 pp. 412-419.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.
Porter et al., "Chimeric Antigen Receptor Therapy for B-cell Malignancies" Journal of Cancer (2011) vol. 2 pp. 331-332.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Rapoport et al., "Restoration of immunity in lymphopenic individuals with cancer by vaccination and adoptive T-cell transfer" Nature Medicine (2005) vol. 11 No. 11 pp. 1230-1237.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Rufer et al. "Transfer of the human telomerase reverse transcriptase (TERT) gene into T lymphocytes results in extension of replicative potential", Blood (2001) pp. 597-603.
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Sebestyen et al., "Human TCR That Incorporate CD3 Induce Highly Preferred Pairing between TCR and Chains following Gene Transfer" Journal of Immunology (2008) vol. 180 pp. 7736-7746.
Shirasu et al., "Functional Design of Chimeric T-Cell Antigen Receptors for Adoptive Immunotherapy of Cancer: Architecture and Outcomes," AntiCancer Res. 32: 2377-2384 (2012).
Barsov et al. "Telomerase and primary T cells: biology and immortalization for adoptive immunotherapy" Immunotherapy (2011) vol. 3, No. 3, pp. 407-421.

(56) References Cited

OTHER PUBLICATIONS

Han et al. "Malignant B Cells Induce the Conversion of CD4+ CD25− T Cells to Regulatory T Cells in B-Cell Non-Hodgkin Lymphoma" PLOS One (2011) vol. 6, No. 12, e28649.
Husebekk et al. "Selection and expansion of T cells from untreated patients with CLL: source of cells for immune reconstitution?" Cytotherapy (2000) vol. 2, No. 3, pp. 187-193.
International Search Report and Written Opinion for International Application No. PCT/US2016/068683 dated Mar. 29, 2017.
Powell et al. "Large-Scale Depletion of CD25+ Regulatory T Cells from Patient Leukapheresis Samples" Journal of Immunotherapy (2005) vol. 28, No. 4, pp. 403-411.
Terakura et al. "Generation of CD19-chimeric antigen receptor modified CD8+ T cells derived from virus-specific central memory T cells" Blood (2012) vol. 119, No. 1, pp. 72-82.
Verbinnen et al. "Contribution of Regulatory T Cells and Effector T Cell Deletion in Tolerance Induction by Costimulation Blockade1" Journal of Immunology (2008) vol. 181, pp. 1034-1042.
Powell et al. "Partial Reduction of Human FOXP3+ CD4 T Cells In Vivo After CD25-directed Recombinant Immunotoxin Administration" J Immunother (2008) vol. 31, pp. 189-198.
Singapore Search Report and Written Opinion for Singapore Application No. 11201705293W dated Mar. 22, 2018.
Lee et al. "T cells expressing CD19 chimeric antigen receptors for acute lymphoblastic leukaemia in children and young adults: a phase 1 doseescalation trial" Lancet (2014) vol. 385, No. 9967, pp. 517-528.
Shvidel et al. "Cell surface expression of CD25 antigen (surface IL-2 receptor alpha-chain) is not a prognostic marker in chronic lymphocytic leukemia: results of a retrospective study of 281 patients" Ann Hematol (2012) vol. 91, pp. 1597-1602 pp. 1597-1602.
Singapore Search Report and Written Opinion for Singapore Application No. 11201708516Y dated Sep. 25, 2018.
Wang et al. "Phenotypic and Functional Attributes of Lentivirus Modified CD19-specific Human CD8+ Central Memory T Cells Manufactured at Clinical Scale" J Immunother (2012) vol. 35, No. 9, pp. 689-701.
Couper et al. "Anti-CD25 antibody-mediated depletion of effector T cell populations enhances susceptibility of mice to acute but not chronic Toxoplasma gondii infection" The Journal of Immunology (2009) vol. 182, No. 7, pp. 3985-3994.
Fujiwara et al. "Profiles of De Novo CD25-Positive Mature B-Cell Lymphomas" Blood (2013) vol. 122, No. 21, pp. 4308 (1-6).
Giordano Attianese et al. "In vitro and in vivo model of a novel immunotherapy approach for chronic lymphocytic leukemia by anti-CD23 chimeric antigen receptor" Blood (2011) vol. 117, No. 18, pp. 4736-4745.
Piper et al. "Chronic lymphocytic leukemia cells drive the global CD4+ T cell repertoire towards a regulatory phenotype and leads to the accumulation of CD4+ forkhead box P3+ T cells" Clinical and Experimental Immunology (2011) vol. 166, No. 2, pp. 154-163.
Slaney et al "Dual-specific Chimeric Antigen Receptor T Cells and an Indirect Vaccine Eradicate a Variety of Large Solid Tumors in an Immunocompetent Self-antigen Setting" Clinical Cancer Research (2017) vol. 23, No. 10, pp. 2478-2490.
Wilkie et al "Dual Targeting of ErbB2 and MUC1 in Breast Cancer Using Chimeric Antigen Receptors Engineered to Provide Complementary Signaling" J Clin Immunol (2012) vol. 32, pp. 1059-1070.
Hinrichs et al. "Adoptive transferred effector cells derived from naive rather than central memory CD8+ T cells mediate superior antitumor immunity" PNAS (2009) vol. 106, No. 41, pp. 17469-17474.

* cited by examiner

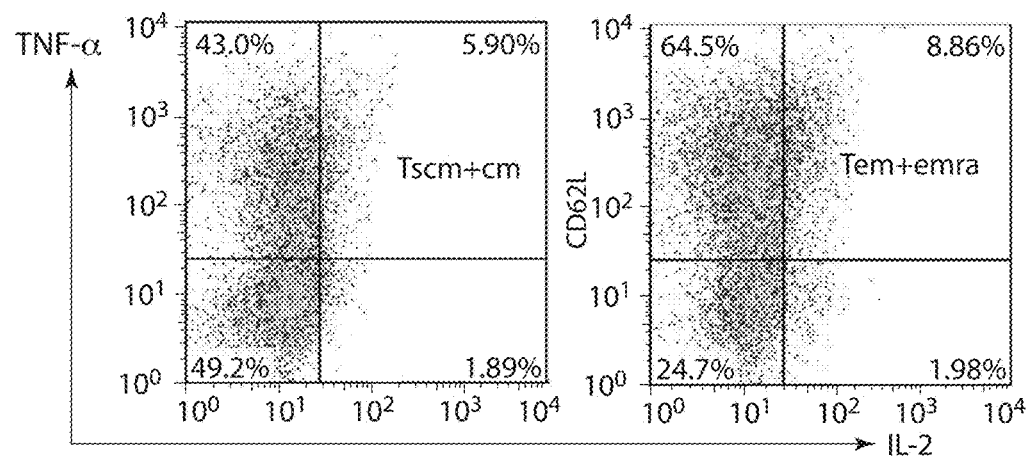
FIG. 6A
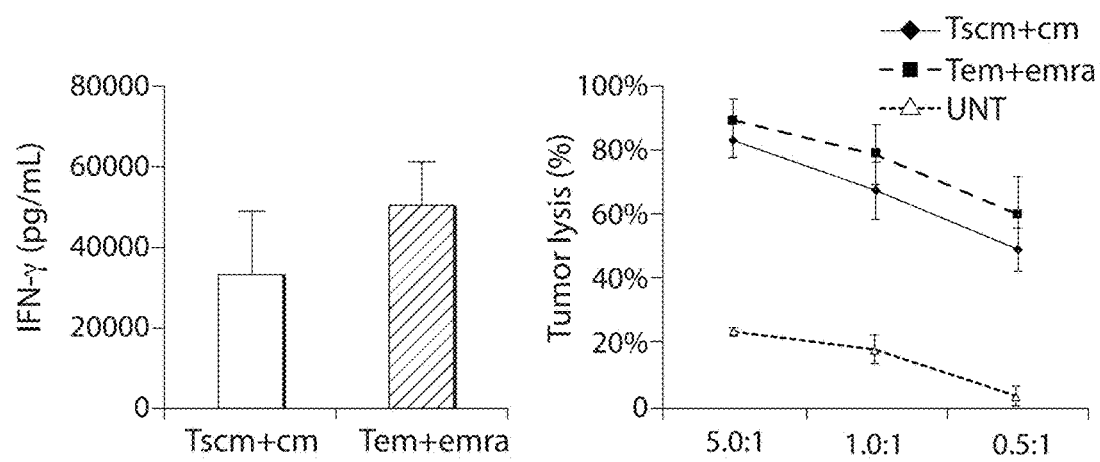
FIG. 6B
FIG. 6C

There is no difference in CART19 cell killing from cells isolated at day 5 and day 9 from expansion Expansion of CAR-grafted peripheral blood T cells Expansion of CAR-grafted peripheral blood T cells Expansion of CAR-grafted cord blood T cells

METHODS FOR IMPROVING THE EFFICACY AND EXPANSION OF IMMUNE CELLS

RELATED APPLICATIONS

This application claims priority to U.S. Ser. No. 62/195,056 filed Jul. 21, 2015, the contents of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Jul. 20, 2016, is named N2067-708110_SL.txt and is 2,031,641 bytes in size.

BACKGROUND OF THE INVENTION

Until about a decade ago, T cell activation in vitro was carried out primarily with the use of mitogenic lectins, such as phytohemagglutinin (PHA) and concanavalin A (Con A). These mitogenic molecules bind to glycoproteins on the cell surface. To achieve T cell receptor (TCR) complex-specific stimulation, antibodies specific to surface molecules, including CD2, CD3, CD28 and CD45 have been used. These antibodies provided the required co-stimulatory signal to trigger complete activation and proliferation of T cells in culture (Frauwirth and Thompson *J Clin Invest* (2002) February; 109(3):295-9). The field has progressed to immobilizing these antibodies to accessory cells, beads or a solid surface for robust expansion of T lymphocytes (Trickett and Kwan *J Immunol Methods* (2003) Apr. 1; 275(1-2):251-5).

However, limitations with existing protocols for activation and expansion of T cells still remain. An exemplary listing of these limitations includes the following. For example, existing protocols rely on the presence of functional TCRs on the surface of T cells. This limits the activation of T cells to those cells with a functional TCR. Primary T lymphocytes are a heterogeneous pool of cells that could include T cells without a functional TCR, thus limiting the T cells populations that can be activated. Production, procurement and use of antibodies to cell surface molecules, such as CD2, CD3, CD28 and CD45, can be expensive and dependent on the availability of such antibodies. Additionally, since complete T cell activation may require two different antibodies (primary stimulant such as anti-CD3, and a secondary stimulant, such as anti-CD28), the cost is further increased. Furthermore, since CD3/CD28 stimuli are typically left in culture for long time durations, the TCRs are being engaged for prolonged, repeated stimulations. Prolonged high levels of TCR stimulation can provide robust activation signal to naïve T cells with concurrent activation-induced cell death (AICD) of memory T cells (Collette Y, et al. *Blood* (1998) Aug. 15; 92(4):1350-63; Kerstan A and Hünig T *J Immunol* (2004) Feb. 1; 172(3): 1341-5; Noel, P J et al. *J Immunol.* 1996 Jul. 15; 157(2): 636-42).

Accordingly, the need exists to improve the in vitro expansion and activation of immune cells, e.g., immune effector cells.

SUMMARY OF THE INVENTION

The present disclosure pertains, at least in part, to methods for improving the expansion and/or activation (e.g., in vitro expansion and/or activation) of immune cells (e.g., immune effector cells). Some embodiments described herein provide for expansion and/or activation of immune cells by transiently expressing a Chimeric Antigen Receptor (CAR) molecule. Said CAR-expressing immune cells can be activated via a ligand of the CAR molecule, e.g., a ligand of the CAR antigen binding domain (e.g., a cognate antigen molecule or an anti-idiotypic antibody molecule). In embodiments, the methods disclosed herein allow for expansion of immune cells, without requiring the presence of a functional T cell receptor, and/or without substantially altering the phenotype of the immune cell. For example, immune effector cells including anergized T cells, hematopoietic stem cells, NK cells, and B-cells can be expanded using the methods described herein. Furthermore, immune cells can be expanded without substantially altering their undifferentiated phenotype and/or without prolonged, repeated stimulation of the T-cell receptor. In certain embodiments, the methods described herein allow for superior proliferation and cell number yield, compared to conventional TCR-stimulated expansion. Thus, the improved methods and compositions (e.g., modified immune cell populations, reaction mixtures) disclosed herein can provide a significant benefit for cellular therapy, e.g., immunotherapy.

Accordingly, in one aspect, the invention features a method of expanding and/or activating a population of immune cells, e.g., immune effector cells. The method includes introducing a CAR molecule (e.g., a nucleic acid encoding a CAR molecule) into the immune cell population, under conditions suitable for expression (e.g., transient expression) of the CAR molecule (e.g., thereby producing a "first CAR-expressing cell population," or a "transient CAR-expressing cell population" as referred to herein). In certain embodiments, the CAR molecule comprises an antigen binding domain (e.g., an antigen binding domain of an antibody molecule). The method includes contacting the first or transient CAR-expressing cell population with a ligand of the CAR molecule, e.g., a ligand of the CAR antigen binding domain (e.g., a cognate antigen molecule (e.g., a recombinant antigen) or an anti-idiotypic antibody molecule), under conditions such that immune cell expansion and/or activation occurs, thereby producing an "expanded and/or activated immune cell population." In embodiments, the ligand of the CAR molecule is present in/on (e.g., immobilized or attached to) a substrate, e.g., a non-naturally occurring substrate. The method can further include culturing the population of immune cells in the presence of the ligand of the CAR molecule.

In a related aspect, the invention features a method of expanding and/or activating a population of immune cells, e.g., immune effector cells. The method includes providing a first CAR-expressing cell population, or a transient CAR-expressing cell population as described herein, and contacting said CAR-expressing cell population with a ligand of the CAR molecule, e.g., a ligand of the CAR antigen binding domain (e.g., a cognate antigen molecule (e.g., a recombinant antigen) or an anti-idiotypic antibody molecule), under conditions such that immune cell expansion and/or activation occurs, thereby producing an "expanded and/or activated immune cell population." In embodiments, the ligand of the CAR molecule is present in/on (e.g., immobilized or attached to) a substrate, e.g., a non-naturally occurring substrate. The method can further include culturing the population of immune cells in the presence of the ligand of the CAR molecule.

In an embodiment, the transiently expressed CAR is produced by transiently introducing a nucleic acid (e.g., an RNA or DNA) encoding a CAR into the cell, under conditions that allow for production of the CAR.

In an embodiment, the transiently expressed CAR is produced by using a sortase. For example, the sortase may be used to couple an extracellular domain (e.g., comprising an antigen-binding domain and a sortase recognition motif) to a sortase acceptor member (e.g., comprising a sortase acceptor motif, a transmembrane domain, and optionally an intracellular signaling domain or a switch domain). In an embodiment, the transiently expressed CAR comprises a sortase transfer signature, e.g., that resulted from the coupling of a sortase recognition motif to a sortase acceptor motif. In an embodiment, the sortase, the CAR, or the sortase acceptor member is as described in PCT/CN2014/090503 filed Nov. 6, 2014, or PCT/CN2014/082600 filed Jul. 21, 2014, each of which is herein incorporated by reference in its entirety.

The aforesaid methods can be carried our in vitro, ex vivo or in vivo.

In some embodiments, the population of immune cells used in the methods described herein is acquired, e.g., obtained, from a blood sample from a subject (e.g., a cancer patient). In one embodiment, the population of immune cells is obtained by apheresis.

In some embodiments, the immune cell population includes immune effector cells, e.g., as described herein. Exemplary immune effector cells include T cells, e.g., alpha/beta T cells and gamma/delta T cells, B cells, natural killer (NK) cells, natural killer T (NKT) cells, mast cells, myeloid-derived phagocytes, or a combination thereof.

In certain embodiments, the immune cell population includes primary T cells or subsets of lymphocytes, including, for example, anergized T cells, naïve T cells, T-regulatory cells, Th-17 cells, stem T cells, or a combination thereof.

In some embodiments, the immune cell population includes peripheral blood mononucleated cells (PBMCs), or cord blood cells, or a combination thereof.

In one embodiment, the immune cell population includes cells that express a low level of, or do not have, a T cell receptor (e.g., a functional T cell receptor). In another embodiment, the immune cell population includes cells that have non-functional or substantially impaired T cell receptors.

In one embodiment, the nucleic acid encoding the CAR molecule (e.g., the first CAR molecule) is an RNA molecule, e.g., an in vitro transcribed (IVT) RNA. In one embodiment, a CAR encoding RNA construct as described herein is introduced into the immune cell population by transfection or electroporation. In one embodiment, the CAR molecule is expressed transiently (e.g., the CAR molecule does not, or does not substantially, integrate into the cellular genome). In one embodiment, the CAR molecule is expressed in the immune cell for a finite period of time or number of cell replications, e.g., less than 50 days (e.g., less than 40, 30, 25, 20, 15, 10, 5 or fewer days).

In one embodiment, the CAR molecule is transiently expressed on the immune cell surface and is internalized post a single ligand (e.g., antigen) stimulation. In embodiments, the immune cell does not receive repeated ligand (e.g., antigen) stimulation.

In other embodiments, the strength of the immune cell stimulation is customized to a desired level, e.g., by adjusting one or both of: the CAR-surface density, or the affinity of the CAR antigen binding domain to the ligand, e.g., the antigen. For example, increasing the CAR-surface density on the immune cell, or increasing the affinity of the CAR binding domain to the ligand (e.g., antigen) may increase the strength of the immune cell stimulation.

In other embodiments, the nucleic acid encoding the CAR molecule (e.g., the first CAR molecule) is a DNA vector or an RNA vector. In one embodiment, the vector is selected from the group consisting of a DNA, an RNA, a plasmid, a lentivirus vector, adenoviral vector, or a retrovirus vector. In one embodiment, the vector is a lentivirus. In one embodiment, the nucleic acid is stably integrated into the cellular genome.

In embodiments, the encoded CAR molecule is as described herein, e.g., a tumor antigen-binding CAR (e.g., CD19 CAR) as described herein.

In another embodiment, the ligand of the CAR molecule is a cancer associated antigen, e.g., a cancer associated antigen recognized by a CAR molecule as described herein, e.g., a CD19 CAR.

In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the ligand of the CAR molecule is present in the substrate (e.g., on the substrate surface). The ligand can be immobilized, attached, or associated covalently or non-covalently (e.g., cross-linked) to the substrate. In one embodiment, the ligand is attached (e.g., covalently attached) to a bead. In the aforesaid embodiments, the immune cell population can be expanded in vitro or ex vivo.

In other embodiments, the substrate is a cell, e.g., a cell expressing the ligand, e.g., a cell expressing the cognate antigen on its surface. In one embodiment, the cognate antigen is heterologous to the cell, e.g., is a recombinant antigen expressed on the cell surface. In another embodiment, the cognate antigen is endogenously expressed on a cell, e.g., a tumor cell. In the aforesaid embodiments, the immune effector cell population can be expanded in vitro, ex vivo or in vivo. In one embodiment, T cells are expanded in vivo, e.g., by lymph node injection, or by injection of the tumor-infiltrating lymphocytes (TIL) into a tumor.

In one embodiment, the CAR-expressing immune cells are cultured in the presence of the ligand of the CAR molecule for a predetermined period (e.g., about 1, 2, 3, 4, 5, 6, 7, 8, 9, 10, 15, 18, 21, 22, 23 or 24 hours) or (e.g., 1, 5, 10, 15, 20, 25, 30, 35, 40, 45 or 50 days). In one embodiment, the CAR-expressing cells are cultured for a period of 4 to 9 days. In one embodiment, the CAR-expressing cells are cultured for a period of 8 days or less, e.g., 7, 6 or 5 days.

In some embodiment, the CAR-expressing immune cell population shows at least 3, 4, 5, 6, 7, 8, 9, 10, 11 or 12 or higher population doublings. In one embodiment, the CAR-expressing immune cell population shows a total of 8-10, or about 9 population doublings.

In one embodiment, the CAR-expressing immune cell population expands to a total of 200-, 300-, 400-, 450-, 500-, 550-, 600-, 650-fold or higher expansion per cell. In one embodiment, the CAR-expressing immune cell population are expanded about 500-fold. In one embodiment, an average cell multiplies to over 400-600, or about 500 cells. In some embodiments, the cell expansion is measured by a method described herein, such as flow cytometry. In one embodiment, the cell expansion is measured at about 5, 10, 15, 20, 25, 30, 35, 40, 45, or 50 days after stimulation with the ligand, e.g., the cognate antigen. In one embodiment, the cell expansion is measured between 10 and 25 days after stimulation with the ligand. In one embodiment, the expansion is measured 8, 9, 10, 11, 12, 13, 14, 15, 16, 17, 18, 19, 20, 21, 22, 23, 24, or 25 days after stimulation with the ligand.

In one embodiment, the expansion and/or activation of the immune cell population using the methods described herein does not substantially stimulate the TCRs on the immune cell. In embodiments, the methods described herein lead to less rapid differentiation of the immune cells and/or promotes "younger" T cell phenotypes in culture. In some embodiments, the expanded and/or activated immune cell population includes immune effector cell having a less differentiated phenotype, e.g., a younger cell, e.g., a young T cell. In some embodiments, a younger T cell may be a naïve T cell ($T_N$), a memory stem cell ($T_{SCM}$), a central memory T cell ($T_{CM}$), or a combination thereof.

In certain embodiments, the methods disclosed herein further include contacting the expanded and/or activated immune cell population with a nucleic acid encoding a second CAR molecule, e.g., a vector comprising a nucleic acid encoding a second CAR, thereby producing a second CAR-expressing cell population.

In one embodiment, the nucleic acid encoding the second CAR molecule is selected from the group consisting of a DNA, an RNA, a plasmid, a lentivirus vector, adenoviral vector, or a retrovirus vector. In one embodiment, the nucleic acid encoding the second CAR molecule vector is a lentivirus.

In other embodiments, the nucleic acid encoding a second CAR molecule is an IVT RNA.

In some embodiment, the first and second CAR molecules are directed to the same antigen, e.g., the same tumor cell antigen. In one embodiment, the first and second CAR molecules are the same CAR molecule. In such embodiments, the immune cell population expressing (e.g., transiently expressing) the first CAR is expanded and/or activated in vitro or ex vivo, e.g., by contacting said immune cell population with the tumor cell antigen or an anti-idiotypic antibody against the CAR binding antibody molecule (e.g., a CD19-antigen or anti-CD19 idiotypic antibody immobilized onto a non-cellular or cellular substrate as described herein). Alternatively, or in combination, the immune cell population expressing (e.g., stably expressing) the second CAR is expanded and/or activated in vivo, e.g. by contacting an endogenous tumor cell antigen (e.g., CD19). In one embodiment, the second CAR-expressing immune cell is administered to a subject, e.g., as part of a therapeutic protocol.

In other embodiments, first and second CAR molecules are directed to different antigens, e.g., different tumor cell antigens. In one embodiment, the first and second CAR molecules are different CAR molecules (e.g., a first and second CAR molecule). In such embodiments, the immune cell population expressing (e.g., transiently expressing) the first CAR is expanded and/or activated in vitro or ex vivo, e.g., by contacting said immune cell population with a first tumor cell antigen or a first anti-idiotypic antibody against the antigen binding domain of the CAR (e.g., a mesothelin antigen or an anti-idiotypic antibody against the mesothelin-binding domain of the CAR molecule immobilized onto a non-cellular or cellular substrate as described herein). Alternatively, or in combination, the immune cell population expressing (e.g., stably expressing) the second CAR is expanded and/or activated in vivo, e.g. by contacting an endogenous second tumor cell antigen (e.g., CD19). In one embodiment, the second CAR-expressing immune cell is administered to a subject, e.g., as part of a therapeutic protocol.

In one embodiment, the first and second CAR is chosen from a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR, e.g., a CAR as described herein. In one embodiment, the first and second CARs are the same. In other embodiments, the first and second CARs are different. Any combination of first and second CAR can be used in the methods disclosed herein.

In certain embodiments, the methods further comprise storing the expanded and/or activated immune cell population after the appropriate expansion period. In one embodiment, the expanded and/or activated immune cell population is cryopreserved according to a method described herein. In one embodiment, the expanded and/or activated immune cell population is cryopreserved in an appropriate media, e.g., an infusible media, e.g., as described herein.

In another aspect, the invention features a method of treating a disorder or condition (e.g., a disorder or condition as described herein), in a subject. The method includes administering to the subject an expanded and/or activated immune cell population made according to one or more of the methods described herein. In embodiments, the method includes acquiring (e.g., obtaining) the expanded and/or activated immune cell population. The expanded and/or activated immune cell population can be obtained from a suitable storage condition, e.g., cryopreservation.

In some embodiments, the immune cell population includes immune effector cells, e.g., a described herein. Exemplary immune effector cells include T cells, e.g., alpha/beta T cells and gamma/delta T cells, B cells, natural killer (NK) cells, natural killer T (NKT) cells, mast cells, hematopoetic stem cells (HSC), myeloic-derived phagocytes, or a combination thereof.

In certain embodiments, the immune cell population includes primary T cells or subsets of lymphocytes, including, for example, anergized T cells; naïve T cells; T-regulatory cells; Th-17 cells; stem T cells, or a combination thereof.

In some embodiments, the immune cell population includes peripheral blood mononucleated cells (PBMCs), or cord blood cells, or a combination thereof.

In yet another aspect the invention features a method of treating, or providing anti-tumor immunity to, a subject having a cancer. The method includes administering to the subject an effective amount of an immune effector cell population (e.g., an expanded and/or activated immune cell population as described herein) that expresses a CAR molecule (e.g., a first and/or second CAR molecule as described herein), alone or in combination with an additional therapy, e.g., a second therapy as described herein.

In some embodiments, the treatment method includes acquiring (e.g., obtaining) the expanded and/or activated immune cell population using one or more of the methods described herein. For example, the expanded and/or activated immune cell population may have been previously obtained by introducing a first CAR molecule (e.g., a nucleic acid molecule encoding the first CAR molecule as described herein, e.g., an IVT RNA encoding the first CAR) under conditions suitable for expression (e.g., transient expression) of the CAR molecule; and contacting said CAR-expressing cell population with a ligand of the CAR molecule, e.g., a ligand of the CAR antigen binding domain (e.g., a cognate antigen molecule (e.g., a recombinant antigen) or an anti-idiotypic antibody molecule), under conditions such that immune cell expansion and/or activation occurs. In embodiments, the ligand of the CAR molecule is present in/on (e.g., immobilized or attached to) a substrate, e.g., a non-naturally occurring substrate, as described herein. The expanded and/or activated immune cell population can be stored under suitable conditions, e.g., cryopreservation, as described herein.

In certain embodiments, the treatment methods disclosed herein further include acquiring (e.g., obtaining) a second CAR-expressing cell population, e.g. a second CAR-expressing cell population as described herein. For example, the expanded and/or activated immune cell population may have been previously contacted with a nucleic acid encoding the second CAR molecule, e.g., a vector comprising a nucleic acid encoding a second CAR. In one embodiment, the nucleic acid encoding the second CAR molecule is selected from the group consisting of a DNA, a RNA, a plasmid, a lentivirus vector, adenoviral vector, or a retrovirus vector. In one embodiment, the nucleic acid encoding the second CAR molecule vector is a lentivirus.

In some embodiment, the first and second CAR molecules are directed to the same antigen molecule, e.g., the same cancer associated antigen. In one embodiment, the first and second CAR molecules are the same CAR molecule. In such embodiments, the immune cell population expressing (e.g., transiently expressing) the first CAR was previously expanded and/or activated in vitro or ex vivo, e.g., by contacting said immune cell population with the cancer associated antigen or an anti-idiotypic antibody against the CAR binding antibody molecule (e.g., a CD19-antigen or anti-CD19 idiotypic antibody immobilized onto a non-cellular or cellular substrate as described herein). In one embodiment, the second CAR-expressing immune cell is administered to a subject, e.g., as part of a therapeutic protocol.

In other embodiments, first and second CAR molecules are directed to different antigens, e.g., different cancer associated antigens. In one embodiment, the first and second CAR molecules are different CAR molecules (e.g., a first and second CAR molecules). In such embodiments, the immune cell population expressing (e.g., transiently expressing) the first CAR was previously expanded and/or activated in vitro or ex vivo, e.g., by contacting said immune cell population with a first cancer associated antigen or a first anti-idiotypic antibody against the antigen binding domain of the CAR molecule (e.g., an antigen or an anti-idiotypic antibody against the binding domain of the CAR molecule immobilized onto a non-cellular or cellular substrate as described herein). In one embodiment, the second CAR-expressing immune cell is administered to a subject, e.g., as part of a therapeutic protocol.

In one embodiment, the first and second CAR molecules are each chosen independently from a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR, e.g., a CAR as described herein. In one embodiment, the first and second CARs are the same. In other embodiments, the first and second CARs are different. Any combination of first and second CAR can be used in the methods disclosed herein.

In one exemplary embodiment, the first CAR is directed to mesothelin and the mesothelin CAR-expressing cell is contacted with a mesothelin antigen or anti-idiotypic antibody against the mesothelin-antigen binding domain of the CAR; and the second CAR is directed to CD19 (e.g., a CD19 CAR disclosed herein). In another exemplary embodiment, the first CAR is directed to CD19 and the CD19 CAR-expressing cell is contacted with a CD19 antigen or anti-idiotypic antibody against the CD19-antigen binding domain of the CAR; and the second CAR is directed to mesothelin (e.g., a mesothelin CAR disclosed herein).

In some embodiments, the immune cell population used in the aforesaid therapeutic methods includes immune effector cells, e.g., a described herein. Exemplary immune effector cells include T cells, e.g., alpha/beta T cells and gamma/delta T cells, B cells, natural killer (NK) cells, natural killer T (NKT) cells, mast cells, hematopoetic stem cells (HSC), myeloic-derived phagocytes, or a combination thereof.

In yet another aspect, the invention features an immune cell preparation or reaction mixture, e.g., comprising a population of immune effector cells (e.g., comprising a first and/or second CAR molecule or a nucleic acid encoding a first and/or second CAR molecule), e.g., made according to the methods described herein. In certain embodiments, the first and second CAR molecules are expressed simultaneously (e.g., completely or partially overlapping expression), or are expressed sequentially.

Additional features or embodiments of any of the aforesaid methods, preparations, and reaction mixtures include one or more of the following:

Immune Cell Expansion and/or Activation

In certain embodiments, methods disclosed herein include expanding and/or activating a population of immune cells, e.g., immune effector cells. The method includes acquiring a population of immune cells and contacting the cells with a nucleic acid encoding a CAR molecule, under conditions suitable for expression (e.g., transient expression) of the CAR molecule, wherein the CAR molecule binds to a ligand, e.g., a cognate antigen molecule (e.g., a recombinant antigen) or an anti-idiotype antibody against the antigen-binding domain of the CAR molecule; and culturing the population of immune cells in the presence of the cognate antigen molecule or the anti-idiotype antibody.

In one embodiment, the population of immune effector cells are autologous to the subject who the cells will be administered to for treatment. In one embodiment, the population of immune effector cells are allogeneic to the subject who the cells will be administered to for treatment.

In one embodiment, the population of immune effector cells are T cells isolated from peripheral blood lymphocytes. In an embodiment, the population of T cells are obtained by lysing the red blood cells and/or by depleting the monocytes. In an embodiment, the population of T cells is isolated from peripheral lymphocytes using, e.g., a method described herein. In one embodiment, the T cells comprise $CD4^+$ T cells. In another embodiment, the T cells comprise $CD8^+$ T cells. In another embodiment, the T cells comprise regulatory T cells. In a further embodiment, the T cells comprise naïve T-cells. In one embodiment, the immune effector cells comprise hematopoietic stem cells (e.g., cord blood cells). In another embodiment, the immune effector cells comprise B cells. In a further embodiment, the immune effector cells comprise NK cells. In another embodiment, the immune effector cells comprise NKT cells. In another embodiment, the immune effector cells comprise Th-17 cells.

In one embodiment, the immune effector cells have a reduced level of T cell receptors or do not have T cell receptors. In another embodiment, the immune effector cells have non-functional or substantially impaired T cell receptors.

In one embodiment, the population of immune effector cells can be obtained from a blood sample from a subject, e.g., obtained by apheresis. In one embodiment, the immune effector cells collected by apheresis are washed to remove the plasma fraction and, optionally, the cells are provided in an appropriate buffer or media for subsequent processing steps. In one embodiment, the cells are washed with a buffer such as, e.g., phosphate buffered saline (PBS). In an embodiment, the cells are washed in a wash solution that lacks one or more divalent cation such as calcium and magnesium. In one embodiment, the immune effector cells are washed in a buffer that has substantially no divalent cations.

In one embodiment, the method comprises generating a population of RNA-engineered cells transiently expressing exogenous RNA from the population of immune effector cells. The method comprises introducing an in vitro transcribed RNA or synthetic RNA into a cell from the population, where the RNA comprises a nucleic acid encoding a CAR, e.g., a CAR described herein, e.g., a CD19 CAR described herein.

In one embodiment the RNA is introduced into the immune effector cells by a method described herein (e.g., electroporation). In one embodiment, at least at least 80%, 85%, 86%, 87%, 88%, 89%, 90%, 91%, 92%, 93%, 94%, 95%, 96%, 97%, 98%, 99% or 100% of the immune effector cells express the CAR mRNA.

In another embodiment, at least at least at least 80%, 85%, 86%, 87%, 88%, 89%, 90%, 91%, 92%, 93%, 94%, 95%, 96%, 97%, 98%, 99% or 100% of the immune effector cells express the CAR on their cell surface.

In one embodiment, the immune effector cells are expanded and/or activated by culturing the immune effector cells in the presence of a ligand, e.g., a cognate antigen molecule or an anti-idiotype antibody. In one embodiment, the immune effector cells are contacted with the cognate antigen molecule or anti-idiotype antibody at least, 2, 3, 4, 5, 6, 7, 8, 9, 10, 11, 12, 13, 14, 15, 16, 17, 18, 19, 20, 21, 22, 23, 24, 28, 32, 36, 36, or 48 hours after the RNA is introduced into the immune effector cells. In one embodiment, the immune effector cells are contacted with the cognate antigen molecule or an anti-idiotype antibody less than 24, 15, 12, 10, or 8 hours after RNA is introduced into the immune effector cells.

In one embodiment, the ligand is a molecule that binds to and/or activates the CAR, e.g., on the cell surface of the population of immune effector cells expressing (e.g., transiently expressing) a CAR (e.g., a CAR described herein, e.g., a CD19 CAR described herein). In one embodiment, the cognate antigen molecule is the cognate antigen of the CAR. In one embodiment, the cognate antigen molecule is a recombinant antigen recognized by the antigen binding portion of the CAR. In one embodiment the cognate antigen molecule is a cancer associated antigen, e.g., a cancer associated antigen described herein, e.g., CD19. In one embodiment, the ligand is an anti-idiotype antibody (e.g., it is an antibody molecule that binds to the antigen binding domain of the CAR) e.g., an anti-CD19 idiotype antibody.

In one embodiment, the ligand is attached to a substrate. In one embodiment, the substrate is a solid support. In one embodiment, the substrate is selected from microtiter plates (e.g., ELISA plates); membranes (e.g., nitrocellulose membranes, PVDF membranes, nylon membranes, acetate derivatives, and combinations thereof); fiber matrix, Sepharose matrix, sugar matrix; plastic chips; glass chips; or any type of bead (e.g., Luminex beads, Dynabeads, magnetic beads, flow-cytometry beads, and combinations thereof). In one embodiment, the substrate is an ELISA plate. In another embodiment, the substrate is a bead, e.g., Dynabeads.

In one embodiment, the CAR expressing immune effector cells are contacted with the ligand-, e.g., antigen-, coated beads at a ratio of 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, or 15:1 beads per immune effector cell. In one embodiment, the CAR expressing immune effector cells are contacted with antigen coated beads at a ratio of 3:1 beads per immune effector cell.

In one embodiment, the immune effector cells are further expanded in an appropriate media (e.g., media described herein) that may, optionally, contain one or more factors for proliferation and/or viability, including serum (e.g., fetal bovine or human serum), interleukin-2 (IL-2), insulin, IFN-γ, IL-4, IL-7, GM-CSF, IL-10, IL-12, IL-15, IL-21, TGFβ, and TNF-α or any other additives for the growth of cells. In one embodiment, the cells are expanded in the presence IL-15 and/or IL-7 (e.g., IL-15 and IL-7). In one embodiment, the immune effector cells are expanded in the presence of IL-2.

In one embodiment, immune effector cells transduced with a nucleic acid encoding a CAR, e.g., a CAR described herein, e.g., a CD19 CAR described herein, are expanded in culture for a period of several hours (e.g., about 2, 3, 4, 5, 6, 7, 8, 9, 10, 15, 18, 21 hours) to about 40 days (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 days). In one embodiment, the cells are expanded for a period of 4 to 9 days. In one embodiment, the cells are expanded for a period of 8 days or less, e.g., 7, 6, 5, 4, or 3 days.

Potency of the immune effector cells can be defined, e.g., by various T cell functions, e.g. proliferation, target cell killing, cytokine production, activation, migration, or combinations thereof. In one embodiment, the immune effector cells, e.g., a CD19 CAR cell described herein, expanded for 5 days show at least one, two, three or four fold increase in cells doublings upon antigen stimulation as compared to the same cells expanded in culture for 9 days under the same culture conditions. In one embodiment, the immune effector cells, e.g., the cells expressing a CD19 CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the immune effector cells, e.g., a CD19 CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one embodiment, the immune effector cells are expanded at least a 200-fold (e.g., 200-fold, 250-fold, 300-fold, 350-fold, 400-fold, 450-fold, 500-fold, 550-fold, or 650-fold) increase in cells, e.g., as measured by a method described herein such as flow cytometry. In one embodiment, the cells are expanded about 500 fold.

In one embodiment, the cell expansion is measured at about 5, 10, 15, 20, 25, 30, 35, 40, 45, or 50 days after stimulation with the ligand, e.g., the cognate antigen molecule. In one embodiment, the cell expansion is measured between 10 and 25 days after stimulation with the ligand, e.g., the cognate antigen molecule. In one embodiment, the expansion is measured 8, 9, 10, 11, 12, 13, 14, 15, 16, 17, 18, 19, 20, 21, 22, 23, 24, or 25 days after stimulation with the ligand, e.g., the cognate antigen molecule.

In one embodiment, the immune effector cells are cryopreserved after the appropriate expansion period. In one embodiment, the cells are cryopreserved according to a method described herein. In one embodiment, the expanded cells are cryopreserved in an appropriate media, e.g., an infusible media, e.g., as described herein.

In one embodiment the method includes contacting the immune effector cells with a nucleic acid encoding a first CAR (e.g., an in vitro transcribed RNA) under conditions suitable for transient expression of the first CAR, wherein the first CAR targets a cognate antigen molecule, and expanding the population of immune effector cells by culturing the first CAR expressing immune effector cells in the presence of the cognate antigen molecule, and further contacting the cells with a vector comprising a nucleic acid encoding a second CAR. In one embodiment, the vector is selected from the group consisting of a DNA, a RNA, a plasmid, a lentivirus vector, adenoviral vector, or a retrovirus vector. In one embodiment, the cell from the population of immune effector cells, is transduced with a vector once, e.g., within one day after population of immune effector cells are obtained from a blood sample from a subject, e.g., obtained by apheresis.

In one embodiment, the first CAR targets a cognate antigen molecule and the second CAR targets the same cognate antigen molecule. In one embodiment, the first CAR targets a cognate antigen molecule and the second CAR a different cognate antigen molecule. In one embodiment, the first CAR targets a cancer associated antigen described herein and the second CAR targets the same cancer associated antigen described herein. In one embodiment, the first CAR that targets a cancer associated antigen described herein and the second CAR targets a different cancer associated antigen described herein. In one embodiment, the first CAR is a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR described herein and the second nucleic acid encodes a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR described herein.

In another aspect, the disclosure features a reaction mixture comprising a population of immune effector cells wherein a plurality of the cells of the population in the reaction mixture comprise a nucleic acid molecule, e.g., in vitro transcribed RNA or synthetic RNA, that comprises a CAR encoding sequence, e.g., a CD19 CAR encoding sequence, e.g., as described herein.

In one embodiment, at least at least at least 80%, 85%, 86%, 87%, 88%, 89%, 90%, 91%, 92%, 93%, 94%, 95%, 96%, 97%, 98%, 99% or 100% of the immune effector cells express the CAR mRNA.

In another embodiment, at least at least at least 80%, 85%, 86%, 87%, 88%, 89%, 90%, 91%, 92%, 93%, 94%, 95%, 96%, 97%, 98%, 99% or 100% of the immune effector cells express the CAR on their cell surface.

In one embodiment, the reaction mixture can further comprise a ligand as described herein (e.g., a cognate antigen molecule or an anti-idiotype antibody). In one embodiment, the ligand is a molecule that binds to and/or activates the CAR on the cell surface of the population of immune effector cells expressing, e.g. transiently expressing, a CAR, e.g., a CAR described herein, e.g., a CD19 CAR described herein. In one embodiment, the ligand is the cognate antigen of the CAR. In one embodiment the cognate antigen is a cancer associated antigen, e.g., a cancer associated antigen described herein, e.g., CD19. In another embodiment the ligand is an anti-idiotype antibody, e.g., an anti-CD19 idiotype antibody.

In one embodiment, the ligand, e.g., the cognate antigen molecule or the anti-idiotype antibody, is attached to a substrate. In one embodiment, the substrate is a solid support. In one embodiment, the substrate is selected from microtiter plates (e.g., ELISA plates); membranes (e.g., nitrocellulose membranes, PVDF membranes, nylon membranes, acetate derivatives, and combinations thereof); fiber matrix, Sepharose matrix, sugar matrix; plastic chips; glass chips; or any type of bead (e.g., Luminex beads, magnetic beads (e.g., Dynabeads), flow-cytometry beads, and combinations thereof). In one embodiment, the substrate is an ELISA plate. In another embodiment, the substrate is magnetic beads, e.g., Dynabeads.

In one embodiment, the CAR expressing immune effector cells and the ligand (e.g., antigen) coated beads are present in a ratio of 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, or 15:1 beads per immune effector cell. In one embodiment, the CAR expressing immune effector cells and the ligand (e.g., antigen) coated beads are present in a ratio of 3:1 beads per immune effector cell.

In one embodiment, the reaction mixture further comprises one or more factors for enhancing proliferation and/or viability, including serum (e.g., fetal bovine or human serum), e.g., one, two, three, four, five or more of: interleukin-2 (IL-2), insulin, IFN-γ, IL-4, IL-7, GM-CSF, IL-10, IL-12, IL-15, IL-21, TGFβ, and TNF-α or any other additives for the growth of cells. In one embodiment, the reaction mixture further comprises IL-15 and/or IL-7. In one embodiment, the cells are expanded in the presence of IL-2.

In one embodiment, a plurality of the cells of the population in the reaction mixture comprise one or both of a nucleic acid encoding a first CAR molecule and a nucleic acid encoding a second CAR molecule, e.g., a CAR described herein.

In one embodiment, the nucleic acid encoding the first CAR is an in vitro transcribed RNA as described herein.

In one embodiment, the nucleic acid encoding the second CAR is a vector selected from the group consisting of a DNA, a RNA, a plasmid, a lentivirus vector, adenoviral vector, or a retrovirus vector.

In one embodiment, the first CAR targets a cognate antigen molecule and the second CAR targets the same cognate antigen molecule.

In one embodiment, the first CAR targets a cognate antigen molecule and the second CAR a different cognate antigen molecule.

In one embodiment, the first CAR targets a cancer associated antigen described herein and the second CAR targets the same cancer associated antigen described herein.

In one embodiment, the first CAR targets a cancer associated antigen described herein and the second CAR targets a different cancer associated antigen described herein.

In one embodiment, the first CAR is chosen from a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR described herein; and the second nucleic acid encodes a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR described herein.

In one embodiment, the reaction mixture further comprises a cryoprotectant or stabilizer such as, e.g., a saccharide, an oligosaccharide, a polysaccharide and a polyol (e.g., trehalose, mannitol, sorbitol, lactose, sucrose, glucose and dextran), salts and crown ethers. In one embodiment, the cryoprotectant is dextran.

Additional features and embodiments of the methods are described herein in the section entitled "Further Embodiments of the Methods, preparations, and reaction mixtures"

CAR Molecules

In accordance with the methods, preparations, and reaction mixtures described herein, an immune effector cell, e.g., obtained by a method described herein, can be engineered to contain a CAR molecule (also referred to herein as "CAR") that targets one or more cancer associated antigens. In some embodiments, the tumor antigen is a tumor antigen described in International Application WO2015/142675, filed Mar. 13, 2015, which is herein incorporated by reference in its entirety.

In some embodiments, the cancer associated antigen (tumor antigen) is chosen from one or more of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8) aNeu5Ac(2-3)bDGalp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

In one embodiment, the cancer associated antigen targeted by the CAR molecule is CD19, e.g., a CD19 CAR described herein (e.g., CTL019). In one embodiment, the CD19 CAR comprises the amino acid, or has the nucleotide sequence shown in Table 4.

In some embodiments, the antigen binding domain of the CAR molecule comprises an antibody, an antibody fragment, an scFv, a Fv, a Fab, a (Fab')2, a single domain antibody (SDAB), a VH or VL domain, or a camelid VHH domain.

In some embodiments, the transmembrane domain of the CAR molecule comprises a transmembrane domain chosen from the transmembrane domain of an alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C.

In certain embodiments, the transmembrane domain of the CAR molecule comprises an amino acid sequence of a CD8 transmembrane domain having at least one, two or three modifications but not more than 20, 10 or 5 modifications of an amino acid sequence of SEQ ID NO: 6, or a sequence with 95-99% identity to an amino acid sequence of SEQ ID NO: 6. In one embodiment, the transmembrane domain comprises the sequence of SEQ ID NO: 6.

In other embodiments, nucleic acid sequence encoding the CD8 transmembrane domain comprises the sequence of SEQ ID NO: 17, or a sequence with 95-99% identity thereof.

In certain embodiments, the antigen binding domain is connected to the transmembrane domain by a hinge region. In one embodiment, the hinge region comprises the amino acid sequence of a CD8 hinge, e.g., SEQ ID NO: 2; or the amino acid sequence of an IgG4 hinge, e.g., SEQ ID NO: 36, or a sequence with 95-99% identity to SEQ ID NO:2 or 36. In other embodiments, the nucleic acid sequence encoding the hinge region comprises a sequence of SEQ ID NO: 13 or SEQ ID NO: 37, corresponding to a CD8 hinge or an IgG4 hinge, respectively, or a sequence with 95-99% identity to SEQ ID NO:13 or 37.

In other embodiments, the CAR comprises an intracellular signaling domain, e.g., a primary signaling domain and/or a costimulatory signaling domain. In some embodiments, the intracellular signaling domain comprises a primary signaling domain. In some embodiments, the intracellular signaling domain comprises a costimulatory signaling domain. In some embodiments, the intracellular signaling domain comprises a primary signaling domain and a costimulatory signaling domain.

In certain embodiments, the primary signaling domain comprises a functional signaling domain of a protein selected from the group consisting of CD3 zeta, CD3 gamma, CD3 delta, CD3 epsilon, common FcR gamma (FCER1G), FcR beta (Fc Epsilon Rib), CD79a, CD79b, Fc gamma RIIa, DAP10, and DAP12.

In one embodiment, the primary signaling domain of the CAR molecule comprises a functional signaling domain of CD3 zeta. The CD3 zeta primary signaling domain can comprise an amino acid sequence having at least one, two or three modifications but not more than 20, 10 or 5 modifications of an amino acid sequence of SEQ ID NO: 9 or SEQ ID NO: 10, or a sequence with 95-99% identity to an amino acid sequence of SEQ ID NO:9 or SEQ ID NO: 10. In some embodiments, the primary signaling domain comprises a sequence of SEQ ID NO:9 or SEQ ID NO: 10. In other embodiments, the nucleic acid sequence encoding the primary signaling domain comprises a sequence of SEQ ID NO:20 or SEQ ID NO: 21, or a sequence with 95-99% identity thereof.

In some embodiments, the intracellular signaling domain of the CAR molecule comprises a costimulatory signaling domain. For example, the intracellular signaling domain can comprise a primary signaling domain and a costimulatory signaling domain. In some embodiments, the costimulatory signaling domain comprises a functional signaling domain of a protein chosen from one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CD5, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D.

In some embodiments, a population of immune effector cells, e.g., T cells, comprise a mixture of cells containing CAR molecules having two or more intracellular signaling domains. In embodiments, the population of immune effector cells comprise one or more CAR-comprising a CD28 signaling domain and a 4-1BB signaling domain. For example, a first immune effector cell comprises a CAR molecule comprising a CD28 signaling domain, and a second immune effector cell comprises a CAR molecule comprising a 4-1BB signaling domain. Expression of CAR molecules comprising a CD28 signaling domain and/or a 4-1BB signaling domain can be transient or stable.

In certain embodiments, the costimulatory signaling domain of the CAR molecule comprises an amino acid sequence having at least one, two or three modifications but not more than 20, 10 or 5 modifications of an amino acid sequence of SEQ ID NO:7 or SEQ ID NO: 16, or a sequence with 95-99% identity to an amino acid sequence of SEQ ID NO:7 or SEQ ID NO: 16. In one embodiment, the costimulatory signaling domain comprises a sequence of SEQ ID NO: 7 or SEQ ID NO: 16. In other embodiments, the nucleic acid sequence encoding the costimulatory signaling domain comprises a sequence of SEQ ID NO:18 or SEQ ID NO: 15, or a sequence with 95-99% identity thereof.

In other embodiments, the intracellular domain of the CAR molecule comprises the sequence of SEQ ID NO: 9 or SEQ ID NO: 10, and the sequence of SEQ ID NO: 7 or SEQ ID NO: 16, wherein the amino acid sequence(s) comprising the intracellular signaling domain are expressed in the same frame and as a single polypeptide chain.

In certain embodiments, the nucleic acid sequence encoding the intracellular signaling domain comprises a sequence of SEQ ID NO:18 or SEQ ID NO: 15, or a sequence with 95-99% identity thereof, and a sequence of SEQ ID NO:20 or SEQ ID NO:21, or a sequence with 95-99% identity thereof.

In some embodiments, the CAR further comprises a leader sequence. In one embodiment, the leader sequence comprises the sequence of SEQ ID NO: 1.

In certain embodiments, the antigen binding domain of the CAR molecule has a binding affinity KD of $10^{-4}$ M to $10^{-8}$ M.

In one embodiment, the antigen binding domain of the CAR molecule is an antigen binding domain described herein, e.g., an antigen binding domain described herein for a target provided above.

In some embodiments, the CAR comprises a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR described herein.

In some embodiments, the CAR comprises a CD19 CAR, e.g., a CD19 CAR described herein. In embodiments, the CD19 CAR comprises an antigen binding domain described herein, e.g., in Table 1 or 4.

In other embodiment, the antigen-binding portion of the CAR recognizes and binds to the extracellular domain of the the mesothelin protein. Exemplary mesothelin CAR sequences are found, for example, in International Publication No. WO 2013/040557 A2, which is incorporated by reference herein in its entirety.

Methods of Treatment/Combination Therapies

In another aspect the invention features a method of treating, or providing anti-tumor immunity to, a subject having a cancer. The method includes administering to the subject an effective amount of an immune effector cell population, wherein the immune effector cell population is, or was previously, expanded by contacting the immune effector cell population, with a nucleic acid encoding a CAR, under conditions suitable for transient expression of the CAR, wherein the CAR targets a cognate antigen molecule; and culturing the population of immune effector cells in the presence of a ligand, e.g., the cognate antigen molecule or an anti-idiotypic antibody molecule. In one embodiment, the nucleic acid is RNA, e.g., in vitro transcribed RNA. In another embodiment, the cognate antigen molecule is a cancer associated antigen molecule. In one embodiment, the cognate antigen molecule or the anti-idiotypic antibody molecule is attached to a substrate, e.g., a bead.

In some embodiments, the method further includes administering to the subject an immune effector cell population comprising a second CAR (e.g., a vector comprising a nucleic acid encoding a second CAR), wherein the immune effector cell population is, or was previously, expanded as described herein. In one embodiment, the vector is selected from the group consisting of a DNA, a RNA, a plasmid, a lentivirus vector, adenoviral vector, or a retrovirus vector.

In one embodiment, the population of immune effector cells, is transduced with a vector once, e.g., within one day after population of immune effector cells are obtained from a blood sample from a subject, e.g., obtained by apheresis. In one embodiment, the first CAR targets a cognate antigen molecule and the second CAR targets the same cognate antigen molecule. In one embodiment, the first CAR targets a cognate antigen molecule and the second CAR a different cognate antigen molecule. In one embodiment, the first CAR targets a cancer associated antigen described herein and the second CAR targets the same cancer associated antigen described herein. In one embodiment, the first CAR that targets a cancer associated antigen described herein and the second CAR targets a different cancer associated antigen described herein.

In one embodiment, the first CAR is a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR described herein and the second nucleic acid encodes a ROR1 CAR, a CD19 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR described herein.

In accordance with methods of treating a disorder as described herein (e.g., a cancer) and providing anti-tumor immunity described herein, in some embodiments, the method comprises administering to a subject a CAR molecule, or a population of immune effector cells made by a method described herein. In some embodiment the population of immune effector cells is engineered to express a CAR molecule, e.g. a CAR described herein, e.g., a CD19 CAR described herein.

Also provided herein is a composition comprising an immune effector cell (e.g., a population of immune effector cells made as described herein) that comprises a CAR molecule (e.g., a CAR molecule as described herein) for use in the treatment of a subject having a disease associated with expression of a tumor antigen, e.g., a disorder as described herein.

In one embodiment, the cancer is a hematological cancer such as, e.g., ALL or CLL. In one embodiment, the cancer, e.g., a hematological cancer described herein, such as, e.g., a leukemia (e.g., ALL or CLL) or a lymphoma (e.g., MCL, HL, or NHL).

In one embodiment, a disease associated with a tumor antigen, e.g., a tumor antigen described herein, e.g., CD19, is selected from a proliferative disease such as a cancer or malignancy or a precancerous condition such as a myelodysplasia, a myelodysplastic syndrome or a preleukemia, or is a non-cancer related indication associated with expression of a tumor antigen described herein. In one embodiment, the disease is a cancer described herein, e.g., a cancer described herein as being associated with a target described herein. In one embodiment, the hematologic cancer is leukemia. In one embodiment, the cancer is selected from the group consisting of one or more acute leukemias including but not limited to B-ALL, T-ALL, ALL; one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and/or "preleukemia" (e.g., a diverse collection of hematological conditions united by ineffective production (or dysplasia) of myeloid blood cells). In certain embodiment, a disease associated with expression of a tumor antigen described herein includes, but is not limited to, atypical and/or non-classical cancers, malignancies, precancerous conditions or proliferative diseases expressing a tumor antigen as described herein; and any combination thereof.

In embodiments, the disease associated with expression of the tumor antigen is selected from the group consisting of a proliferative disease, a precancerous condition, a cancer, and a non-cancer related indication associated with expression of the tumor antigen.

In another embodiment, the disease associated with a tumor antigen described herein is a solid tumor. In embodiments, the cancer is chosen from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In certain embodiments of any of the aforesaid methods or uses, the tumor antigen associated with the disease is chosen from one or more of: CD19, CD123, CD22, CD30, CD171, CS-1, CLL-1 (CLECL1), CD33, EGFRvIII, GD2, GD3, BCMA, Tn Ag, PSMA, ROR1, FLT3, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, FAP, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, legumain, HPV E6, E7, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, and IGLL1.

In one embodiment, the population of cells are autologous to the subject administered the population. In one embodiment, the population of cells is allogeneic to the subject administered the population. In one embodiment, the subject is a human.

In one embodiment, the population of immune effector cells transduced with a nucleic acid encoding a CAR, e.g., a CAR described herein, e.g., a CD19 CAR described herein, are expanded, e.g., by a method described herein. In one embodiment, the cells are expanded for a period of 8 days or less, e.g., 7, 6, 5, 4, or 3 days. In one embodiment, the cells, e.g., a CD19 CAR cell described herein, are expanded in culture for 5 days, and the resulting cells are more potent than the same cells expanded in culture for 9 days under the same culture conditions, e.g., as described herein.

In one embodiment, the subject is administered $10^4$ to $10^6$ immune effector cells per kg body weight of the subject. In one embodiment, the subject receives an initial administration of a population of immune effector cells (e.g., an initial administration of $10^4$ to $10^6$ immune effector cells per kg body weight of the subject, e.g., $10^4$ to $10^5$ immune effector cells per kg body weight of the subject), a plurality of which comprise the nucleic acid encoding a CAR, e.g., a CAR described herein, e.g., a CD19 CAR described herein, and one or more subsequent administrations of a population of immune effector cells (e.g., one or more subsequent administration of $10^4$ to $10^6$ immune effector cells per kg body weight of the subject, e.g., $10^4$ to $10^5$ immune effector cells per kg body weight of the subject), a plurality of which comprise a nucleic acid encoding a CAR, e.g., a CAR described herein, e.g., a CD19 CAR described herein. In one embodiment, the one or more subsequent administrations are administered less than 15 days, e.g., 14, 13, 12, 11, 10, 9, 8, 7, 6, 5, 4, 3, or 2 days after the previous administration, e.g., less than 4, 3, 2 days after the previous administration. In one embodiment, the subject receives a total of about $10^6$ immune effector cells per kg body weight of the subject over the course of at least three administrations of a population of immune effector cells, e.g., the subject receives an initial dose of $1\times10^5$ immune effector cells, a second administration of $3\times10^5$ immune effector cells, and a third administration of $6\times10^5$ immune effector cells, and, e.g., each administration is administered less than 4, 3, 2 days after the previous administration.

In certain embodiments, the methods or uses are carried out in combination with an agent that increases the efficacy of the immune effector cell, e.g., an agent as described herein.

For example, in one embodiment, the agent can be an agent, which inhibits an inhibitory molecule. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta, or a fragment of any of these (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one embodiment, the cells expressing a CAR molecule, e.g., a CAR molecule described herein, are administered in combination with an agent that ameliorates one or more side effect associated with administration of a cell expressing a CAR molecule, e.g., an agent described herein.

In one embodiment, a CAR molecule, e.g., a CAR molecule described herein, is administered in combination with a B-cell inhibitor. For example, a CD19 CAR-expressing cell is administered in combination with one or more additional B-cell inhibitors. In some embodiments, the B-cell inhibitor is a second CD19 inhibitor. In some embodiments, the B-cell inhibitor is an inhibitor of one or more of CD10, CD19, CD20, CD22, CD34, CD123, FLT-3, ROR1, CD79b, CD179b, or CD79a.

In some embodiments, the B-cell inhibitor is a small molecule inhibitor; a polypeptide, e.g., a soluble ligand, an antibody, or antigen-binding fragment thereof that binds to a B-cell antigen (e.g., one or more of CD10, CD19, CD20, CD22, CD34, CD123, FLT-3, ROR1, CD79b, CD179b, or CD79a); or an inhibitory nucleic acid (e.g., a double stranded RNA (dsRNA), small interfering RNA (siRNA), or short hairpin RNA (shRNA)). In other embodiments, the B-cell inhibitor is a cell that expresses a CAR (e.g., a CAR-expressing immune effector cell) that binds to a B-cell antigen (e.g., one or more of CD10, CD19, CD20, CD22, CD34, CD123, FLT-3, ROR1, CD79b, CD179b, or CD79a).

In one aspect, the CAR (e.g., a CD19 CAR, a mesothelin CAR, a ROR1 CAR, a CD20 CAR, a CD22 CAR, a CD123 CAR, a CD10 CAR, a CD34 CAR, a FLT-3 CAR, a CD79b CAR, a CD179b CAR, or a CD79a CAR) comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one aspect an exemplary CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

Subjects

In one embodiment, the subject, e.g., the subject from which immune cells are acquired and/or the subject treated, is a human, e.g., a cancer patient.

In certain embodiments, the subject has a disease associated with expression of a tumor- or cancer associated-antigen, e.g., a disease as described herein. In one embodiment, the subject has a cancer, e.g., a cancer as described herein.

In one embodiment, the subject has a cancer that is chosen from a hematological cancer, a solid tumor, or a metastatic lesion thereof. Exemplary cancers include, but are not limited to, B-cell acute lymphocytic leukemia (B-ALL), T-cell acute lymphocytic leukemia (T-ALL), acute lymphocytic leukemia (ALL), chronic myelogenous leukemia (CML), chronic lymphocytic leukemia (CLL), B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma (NHL), Hodgkin's lymphoma (HL), plasmablastic lymphoma, plasmacytoid dendritic cell neoplasm, and Waldenstrom macroglobulinemia. In one embodiment, the cancer is ALL. In another embodiment, the cancer is CLL.

In embodiments, the subject does not have a relapsed cancer. In other embodiments, the subject has a relapsed cancer.

In one embodiment, the immune cell (e.g., the population of immune effector cells) is acquired, e.g., obtained, from a subject having a haematological cancer, e.g., a leukemia, e.g., CLL, ALL, or a lymphoma, e.g., MCL, NHL, or HL.

Further Embodiments of the Methods, Preparations, and Reaction Mixtures

In accordance with the methods of treating and/or making (e.g., expanding and/or activating), preparations, and reaction mixtures described herein, in embodiments, the method further comprises removing T regulatory cells, e.g., CD25+ T cells, from the immune cell population, e.g., to thereby provide a population of T regulatory-depleted cells, e.g., CD25+ depleted cells, that are suitable for expression of a CAR.

In one embodiment, the population of T regulatory-depleted cells contains less than 30%, 25%, 20%, 15%, 10%, 5%, 4%, 3%, 2%, 1% of CD25+ cells.

In one embodiment, the immune cell population includes cells of a subject having cancer, e.g., a subject having a CD25 expressing cancer such as, e.g., chronic lymphocytic leukemia (CLL). In one embodiment, the population of T regulatory-depleted cells contains less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of tumor cells.

In one embodiment, the immune cell population is autologous to the subject who the cells will be administered to for treatment. In one embodiment, the population of immune effector cells are allogeneic to the subject who the cells will be administered for treatment.

In one embodiment, the T regulatory cells, e.g., CD25+ T cells, are removed from the population using an anti-CD25 antibody, or fragment thereof, or a CD25-binding ligand, e.g. IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Militenyi™. In one embodiment, the ratio of cells to CD25 depletion reagent is $1e^7$ cells to 20 uL, or $1e^7$ cells to 15 uL, or $1e^7$ cells to 10 uL, or $1e^7$ cells to 5 uL, or $1e^7$ cells to 2.5 uL, or $1e^7$ cells to 1.25 uL.

In one embodiment, the population of T regulatory-depleted cells, e.g., CD25+ depleted cells, are suitable for expression of a CAR described herein, e.g., a CD19 CAR described herein. In one embodiment, the population of T regulatory-depleted cells contains less than 30%, 25%, 20%, 15%, 10%, 5%, 4%, 3%, 2%, 1% of the leukemia cells, e.g., CLL cells, ALL cells, or lymphoma cells, e.g., MCL cells, NHL cells, or HL cells. In one embodiment, the population of immune effector cells are obtained from a subject having CLL, and the population of T regulatory-depleted cells, e.g., CD25+ depleted cells, contains less than 30%, 25%, 20%, 15%, 10%, 5%, 4%, 3%, 2%, 1% of the leukemia cells, e.g., CLL cells and are suitable for expression of a CD19 CAR described herein. In one embodiment, the population of T regulatory-depleted cells contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the population of T regulatory-depleted cells contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In one embodiment, the method of making further comprises removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order. In one embodiment, the method of making further comprises removing cells from the population which express a check point inhibitor, e.g., a check point inhibitor described herein, e.g., one or more (e.g., one, two, or three) of: of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

In one embodiment, the method further comprises removing cells from the population which express CD14, to thereby provide a population of T regulatory-depleted, e.g., CD25+ depleted cells, and CD14+ depleted cells. In one embodiment, CD14+ cells are removed simultaneously with the T regulatory, e.g., CD25+ cells. For example, an anti-CD25 antibody, or fragment thereof, and an anti-CD14 antibody, or fragment thereof, can be attached to the same bead which can be used to remove the cells; or an anti-CD25 antibody, or fragment thereof, and the anti-CD14 antibody, or fragment thereof, can be attached to separate beads, a mixture of which can be used to remove the cells. In other embodiments, the removal of T regulatory cells, e.g., CD25+ cells, and the removal of the CD14+ cells is sequential, and can occur, e.g., in either order.

In one embodiment, the population of immune effector cells provided have been selected based upon the expression of one or more markers, e.g., 1, 2, 3, 4, 5, 6, 7, or more of: CD3, CD28, CD4, CD8, CD27, CD127, CD45RA, and CD45RO, e.g., the provided population of immune effector cells (e.g., T cells) are CD3+ and/or CD28+.

In one embodiment, the method further comprises obtaining a population of immune effector cells, e.g., T cells, enriched for the expression of one or more markers, e.g., 1, 2, 3, 4, 5, 6, 7, or more of: CD3, CD28, CD4, CD8, CD27, CD127, CD45RA, and CD45RO. In an embodiment, population of immune effector cells are enriched for CD3+ and/or CD28+ cells. For example, T cells isolated by incubation with anti-CD3/anti-CD28 conjugated beads are obtained. In one embodiment, the method further comprises selecting cells from the population of T regulatory-depleted cells, e.g., CD25+ depleted cells, which express one or more markers, e.g., 1, 2, 3, 4, 5, 6, 7, or more of: CD3, CD28, CD4, CD8, CD45RA, and CD45RO.

In one embodiment, the method further comprises activating the population of T regulatory depleted cells, e.g., CD25+ depleted cells, e.g., by a method described herein.

In one embodiment, the method of making further comprises transducing a cell from the population of T regulatory-depleted cells, e.g., the population of CD25+ depleted cells, with a vector comprising a nucleic acid encoding a CAR, e.g., a CAR described herein, e.g., a CD19 CAR described herein. In one embodiment, the vector is selected from the group consisting of a DNA, a RNA, a plasmid, a lentivirus vector, adenoviral vector, or a retrovirus vector. In one embodiment, the cell from the population of T regulatory-depleted cells, e.g., the population of CD25+ depleted cells, is transduced with a vector once, e.g., within one day after population of immune effector cells are obtained from a blood sample from a subject, e.g., obtained by apheresis.

In one embodiment, the method further comprises generating a population of RNA-engineered cells transiently expressing exogenous RNA from the population of T regulatory-depleted cells, e.g., the population of CD25+ depleted cells. The method comprises introducing an in vitro transcribed RNA or synthetic RNA into a cell from the population, where the RNA comprises a nucleic acid encoding a CAR, e.g., a CAR described herein, e.g., a CD19 CAR described herein.

In one embodiment, the cells are expanded in an appropriate media (e.g., media described herein) that may, optionally, contain one or more factor for proliferation and/or viability, including serum (e.g., fetal bovine or human serum), interleukin-2 (IL-2), insulin, IFN-γ, IL-4, IL-7, GM-CSF, IL-10, IL-12, IL-15, IL-21, TGFβ, and TNF-α or any other additives for the growth of cells.

In one embodiment, the cells are expanded in an appropriate media (e.g., media described herein) that includes one or more interleukins that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence IL-15 and/or IL-7 (e.g., IL-15 and IL-7).

In one embodiment, the cells are cryopreserved after the appropriate expansion period. In one embodiment, the cells are cryopreserved according to a method described herein. In one embodiment, the expanded cells are cryopreserved in an appropriate media, e.g., an infusible media, e.g., as described herein.

In one embodiment, the method of making further comprises contacting the population of immune effector cells with a nucleic acid encoding a telomerase subunit, e.g., hTERT. In an embodiment, the nucleic acid is DNA or RNA.

In one embodiment, the method further comprises, prior to expansion, removing T regulatory cells, e.g., CD25+ T cells, from the population, to thereby provide a population of T regulatory-depleted cells, e.g., CD25+ depleted cells to be expanded. In one embodiment, the T regulatory cells, e.g., CD25+ cells, are removed by a method described herein.

In one embodiment, the method further comprises, prior to expansion, removing T regulatory cells, e.g., CD14+ cells, from the population, to thereby provide a population of CD14+ depleted cells to be expanded. In one embodiment, the T regulatory cells, e.g., CD14+ cells, are removed by a method described herein.

In one embodiment, the method further comprises contacting the population of immune effector cells with a nucleic acid encoding a telomerase subunit, e.g., hTERT. In an embodiment, the nucleic acid is DNA or RNA.

In embodiments, the method comprises contacting the population of immune effector cells with a nucleic acid encoding a CAR, and a nucleic acid encoding a telomerase subunit, e.g., hTERT, under conditions that allow for CAR and telomerase expression.

In an embodiment, the nucleic acid encoding the telomerase subunit is RNA. In another embodiment, the nucleic acid encoding the telomerase subunit is DNA. In an embodiment, the nucleic acid encoding the telomerase subunit comprises a promoter capable of driving expression of the telomerase subunit.

In embodiments, the method of making comprises contacting the population of immune effector cells with a nucleic acid encoding a CAR and an RNA encoding a telomerase subunit, e.g., hTERT, under conditions that allow for CAR and telomerase expression.

In an embodiment, the nucleic acid encoding the CAR and the RNA encoding the telomerase subunit are part of the same nucleic acid molecule. In an embodiment the nucleic acid encoding the CAR and the RNA encoding the telomerase subunit are part of separate nucleic acid molecules.

In an embodiment, the method comprises contacting the population of immune effector cells with a nucleic acid encoding the CAR and the RNA encoding the telomerase subunit at substantially the same time. In an embodiment, the method of making comprises contacting the population of immune effector cells with a nucleic acid encoding the CAR before contacting the population of immune effector cells with the RNA encoding the telomerase subunit. In an embodiment, the method comprises contacting the population of immune effector cells with a nucleic acid encoding the CAR after contacting the population of immune effector cells with the RNA encoding the telomerase subunit.

In an embodiment, the RNA encoding the telomerase subunit is mRNA. In an embodiment, the RNA encoding the telomerase subunit comprises a poly(A) tail. In an embodiment, the RNA encoding the telomerase subunit comprises a 5' cap structure.

In an embodiment, the method comprises transfecting the immune effector cells with the RNA encoding the telomerase subunit. In an embodiment, the method of making comprises transducing the immune effector cells with the RNA encoding the telomerase subunit. In an embodiment, the method of making comprises electroporating the immune effector cells with the RNA encoding the telomerase subunit, under conditions that allow for CAR and telomerase expression.

In embodiments, the method comprises providing a population of immune effector cells (e.g., T cells or NK cells) that express a CAR and/or comprise a nucleic acid encoding a CAR; and contacting the population of immune effector cells with a nucleic acid encoding a telomerase subunit, e.g., hTERT, under conditions that allow for hTERT expression.

In embodiments, the method comprises providing a population of immune effector cells (e.g., T cells or NK cells) that express a nucleic acid encoding a telomerase subunit, e.g., hTERT, and and contacting the population of immune effector cells with a nucleic acid encoding a CAR, under conditions that allow for CAR expression.

Immune Effector Cell Preparations

In some embodiments, an immune effector cell preparation (e.g., a reaction mixture, or a population of immune effector cells) described herein is made by a method described herein.

In embodiments, the population of immune effector cells has been selected based upon the expression of one or more markers, e.g., CCR7, CD62L, CD45RO, and CD95, e.g., the population of immune effector cells (e.g., T cells) are CCR7+ and CD62L+.

In embodiments, the naïve T cells are identified based upon an expression pattern of CCR7+, CD62L+, CD45RO−, CD95−, wherein the stem central memory T cells are identified based upon an expression pattern of CCR7+, CD62L+, CD45RO−, CD95+, and wherein the central memory T cells are identified based upon an expression pattern of CCR7+, CD62L+, CD45RO+, CD95+.

In embodiments, an immune effector cell preparation described herein comprises a nucleic acid encoding a CAR, e.g., a CAR as described herein.

In embodiments, an immune effector cell preparation described herein comprises a nucleic acid encoding an exogenous telomerase subunit, e.g., hTERT. In an embodiment, the nucleic acid encoding an exogenous telomerase subunit is RNA, e.g., mRNA.

In embodiments, an immune effector cell preparation described herein comprises a CAR, e.g., a CAR as described herein; and an exogenous telomerase subunit, e.g., hTERT. In an embodiment, the cell does not comprise DNA encoding the exogenous telomerase subunit. For instance, the cell may have been contacted with mRNA encoding the exogenous telomerase subunit.

In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells. In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD25 expressing tumor cells, e.g., CLL cells. In one embodiment, the immune effector cell preparation contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the immune effector cell preparation contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of a checkpoint inhibitor expressing cells, e.g., a PD1+ cells, LAG3+ cells, or TIM3+ cells.

In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD14+ cells.

In embodiments, the immune effector cell preparation described herein comprises a population of autologous immune effector cells, e.g., a plurality of which are transfected or transduced with a vector comprising a nucleic acid molecule encoding a CAR, e.g., a CAR described herein, e.g., a CD19 CAR described herein, wherein the immune effector cell preparation contains less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of tumor cells, e.g., CLL cells. In one embodiment, the immune effector cell preparation contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the immune effector cell preparation contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In one embodiment, the reaction mixture can further comprise an agent that activates and/or expands to cells of the population, e.g., an agent that stimulates a CD3/TCR complex associated signal and/or a ligand that stimulates a costimulatory molecule on the surface of the cells, e.g., as described herein. In one embodiment, the agent is a bead conjugated with anti-CD3 antibody, or a fragment thereof, and/or anti-CD28 antibody, or a fragment thereof.

In embodiments, a reaction mixture described herein comprises a population of T regulatory-depleted cells containing less than 50%, 40%, 30%, 25%, 20%, 15%, 10%, 5%, 4%, 3%, 2%, 1% of CD25+ cells. In one embodiment, the reaction mixture comprises a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD25 expressing tumor cells, e.g., CLL cells. In one embodiment, the population of cells contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the population of cells contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In one embodiment, the reaction mixture comprises a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of a checkpoint inhibitor expressing cells, e.g., a PD1+ cells, LAG3+ cells, or TIM3+ cells. The reaction mixture may further comprise a buffer or other reagent, e.g., a PBS containing solution.

In one embodiment, the reaction mixture comprises a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD14+ cells. The reaction mixture may further comprise a buffer or other reagent, e.g., a PBS containing solution.

In one embodiment, the reaction mixture further comprises one or more factor for proliferation and/or viability, including serum (e.g., fetal bovine or human serum), interleukin-2 (IL-2), insulin, IFN-γ, IL-4, IL-7, GM-CSF, IL-10, IL-12, IL-15, IL-21, TGFβ, and TNF-α or any other additives for the growth of cells. In one embodiment, the reaction mixture further comprises IL-15 and/or IL-7.

In one embodiment, a plurality of the cells of the population in the reaction mixture comprise a nucleic acid molecule, e.g., a nucleic acid molecule described herein, that comprises a CAR encoding sequence, e.g., a CD19 CAR encoding sequence, e.g., as described herein.

In one embodiment, a plurality of the cells of the population in the reaction mixture comprise a vector comprising a nucleic acid sequence encoding a CAR, e.g., a CAR described herein, e.g., a CD19 CAR described herein. In one embodiment, the vector is a vector described herein, e.g., a vector selected from the group consisting of a DNA, a RNA, a plasmid, a lentivirus vector, adenoviral vector, or a retrovirus vector.

In one embodiment, the reaction mixture further comprises a cryoprotectant or stabilizer such as, e.g., a saccharide, an oligosaccharide, a polysaccharide and a polyol (e.g., trehalose, mannitol, sorbitol, lactose, sucrose, glucose and dextran), salts and crown ethers. In one embodiment, the cryoprotectant is dextran.

In embodiments, the reaction mixture comprises a population of immune effector cells wherein a plurality of the cells of the population in the reaction mixture comprise a nucleic acid molecule, e.g., a nucleic acid molecule described herein, that comprises a CAR encoding sequence, e.g., a CD19 CAR encoding sequence, e.g., as described herein, and IL-7 and/or IL-15.

In one embodiment, a plurality of the cells of the population in the reaction mixture comprise a vector comprising a nucleic acid sequence encoding a CAR, e.g., a CAR described herein, e.g., a CD19 CAR described herein. In one embodiment, the vector is a vector described herein, e.g., a vector selected from the group consisting of a DNA, a RNA, a plasmid, a lentivirus vector, adenoviral vector, or a retrovirus vector.

Other features, objects, and advantages of the invention will be apparent from the description and drawings, and from the claims.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

BRIEF DESCRIPTION OF THE FIGURES

FIG. 1A is a schematic diagram of C4-27z CAR vector. FIG. 1B is a graph showing the overall accumulation of CAR-T cells in response to various cytokines exposure. T cells were transduced and exposed to various exogenous cytokines with final concentrations of 10 ng/mL from the next day (day 0). The numbers of CAR-T cells were calculated based on the number of T cells and the percentages of CAR expression. The curves are representative of 6 donors. *P<0.05, ***P<0.001. NC, no cytokine. FIG. 1C is a histogram showing the proliferation of T cells in response to various cytokines. On day 7 after lentivirus transduction, T cells in NC group were labeled with CFSE (2.5 μM), and then exposed to various cytokines. Seven days later, T cells were analyzed for CFSE dilution by flow cytometry. FIG. 1D is a graph showing the viability of T cells 15 days after lentiviral transduction. T cells from various cytokine groups are stained with Annexin V and 7-AAD, and then analyzed for the proportions of viable cells (both Annexin V and 7-AAD negative). *P<0.05, **P<0.01 versus IL-2 group (n=6).

FIG. 2A shows CD95 expression in CD45RA+ CD62L+ subpopulation of T cells before transduction and CAR-T cells 15 days after transduction. FIGS. 2B and 2C are graphs showing the increase of memory stem T cell (Tscm) proportions in CD4+ (FIG. 2B) and CD8+ T cells (FIG. 2C) after lentiviral transduction. Tscm are defined as CD45RA+CD62L+CD95+CCR7+ T cell subsets. FIG. 2D is a graph showing the correlation between the amount of naïve T (Tn, defined as CD45RA+CD62L+CD95− subpopulation) in T cells pre-transduction and the proportion of Tscm in CAR-T cells after transduction (n=6). Left bars represents the percentages of Tn in CD4+ and CD8+ T cells before transduction and right bars represents the percentages of Tscm in CD4+ and CD8+ CAR-T cells. *P<0.05, **P<0.01. FIG. 2E is a graph showing Self-renew and differentiation of different subsets of CAR-T cells. FACS-sorted CAR+ Tscm, Tcm, Tem and Temra cells are cultured exposed to IL-2 (10 ng/mL) for 3 days, then analyzed the phenotypes based on CD45RA and CD62L expression (n=3). FIG. 2F is a histogram plot showing the proliferation of various subsets of CAR-T cells in response to IL-2. FACS-sorted CAR+ Tscm, Tcm, Tem and Temra cells were labeled with CFSE (2.5 µM), and then cultured exposed to IL-2 (10 ng/mL) for 3 days. Three days later, T cells were analyzed for CFSE dilution.

FIG. 3A demonstrates that CD45RA expression is inversely correlated with CFSE intensity. FIG. 3B shows that for all cytokine groups (IL-2, IL-7, IL-15, IL-18 and IL-21), CD45RA+ T cells exhibited much lower CFSE levels than CD45RA dim and negative T cells indicating that CD45RA+ T cells had stronger proliferation activity than CD45RA− T cells.

FIG. 4 is a series of graphs showing the quantitation of CD45RA, CD62L, CCR7, CD27, CD28 and IL7Rα expression by FACS on the surface of CAR-T cells in indicated cytokine groups. The histograms represent mean value±SEM of expression levels from 6 independent donors. *P<0.05, **P<0.01 versus IL-2 group.

FIGS. 5A, 5B, and 5C are quantitative plots showing the percentages of cytokine-producing CAR-T cells in various cytokine groups (n=6) for production of IFNγ (FIG. 5A), TNF-α (FIG. 5B) and IL-2 (FIG. 5C). Lentiviral transduced T cells are exposed to indicated cytokines for 14 days, and then co-cultured with SKOV3 cells for 5 hours before harvested for flow cytometry analysis. FIG. 5D is a graph showing the antigen specific cytotoxic activity of CAR-T cells. Fourteen days after indicated cytokine exposure, the CAR-T cells were assessed for cytolytic ability by using a luciferase-based assay after 18-hour coculture with SKOV3 at the indicated E/T ratios. Untransduced T cells (UNT) served as negative effector controls. Data shown are mean value±SEM of six independent cytolytic assays.

FIG. 6A-6C: shows the phenotype and function of the CAR-T cells described above in FIG. 5. FIGS. 6A and 6B show that CD62L+ CAR-T cells (Tscm and Tcm) exhibited less cytokine production activity (FIGS. 6A and 6B) and weaker cytolytic capacity (FIG. 6C) when compared with CD62L− CAR-T cells (Tem and Temra).

FIG. 7A depicts two graphs showing the overall accumulation and viability of CAR-T previously exposed to indicated cytokines upon antigen challenge. The T cells exposed to indicated cytokines are harvested on day 15, and then co-cultured with SKOV3 at E/T ratios of 5:1 for 7 days. The expansions of CAR-T cells are calculated and the viability of T cells are evaluated on the seventh day. FIG. 7B is two graphs showing the distribution of memory T subsets of CD4+ and CD8+ CAR-T cells in various cytokine groups. N.S., no statistical difference.

FIG. 8A Tumor growth curves of mice treated with various cytokine exposed C4-27z CAR-T cells, anti-CD19-27z CAR-T cells and untransduced T cells. The data are presented as mean value±SEM. The arrow indicates the time of T cell infusion. FIG. 8B is a graph showing the quantitation of circulating human CD4+ and CD8+ T cell counts in mice peripheral blood 15 days after the first dose of CAR-T cell infusion. FIG. 8C is a graph showing the quantitation of CAR expression on circulating human CD4+ and CD8+ T cells in mice blood.

FIG. 10A is a graph showing the total cell number at the indicated days in culture. FIG. 10B is a graph showing the quantified population doublings at each indicated day in culture. FIG. 10C shows the percentage of viable cells at the indicated days in culture.

FIG. 26A is a schematic diagram of the different CAR constructs used in Example 4.

FIG. 32A is a schematic of the CAR constructs compared in Example 6. Both CARs contain a single-chain variable fragment of the FMC63 antibody that recognizes human CD19 or the SS1 scFv that binds human mesothelin. The transmembrane (TM) and intracellular domains are indicated. FIG. 32B is a graph depicting flow cytometric analysis of cell surface expression of the CARs on day 1 after electroporation in comparison to a No-CAR electroporation only (Mock) control. The right panel shows the mean fluorescence intensities (MFIs) of the CARs detected with an anti-idiotype reagent. Data are representative of independent experiments verified with cells from over 25 individual healthy human donors. FIG. 32C is a schematic of the study design. CD8+ T cells are electroporated with in vitro transcribed RNA. After the cells are allowed to rest overnight, the CAR expression is confirmed and the in vitro culture commences in the presence of cognate antigen-coated beads and cytokines.

FIG. 33A shows CD69 levels measured on cell surface 24 hours after co-culture with cognate antigen. FIG. 33B shows CD19 CAR T cell growth; CD4+ and CD8+ T cells were stimulated as in FIG. 33A and as described in Example 6. Data are representative of at least ten different healthy donors. FIG. 33C shows mesothelin CAR T cell growth of bulk CD8+ T cells (left) or naïve (CD45RO−CD62L+CD8+) T cells (right). CAR T cells were stimulated using beads coated with mesothelin-Fc. FIG. 33D shows representative plots (from at least six donors) of cell surface expression CCR7 and CD45RO on CAR T cells at specified time points during culture. Cells shown have been pre-gated for live CD3+ CD8+ T cells. Numbers shown are percentages of cells detected in each gate. FIG. 33E shows relative change of Tcm and Tem subsets in 28z and BBzCD19 CAR T cell culture at different time points. Absolute numbers of live cells were calculated for each population at the specified time points. The graphs show relative fold change of Tcm or Tem in BBz CAR T cells normalized to 28z CAR T cells. Data are plotted as mean±SEM (**, $p<0.0001$, , $p=<0.01$).

As shown in FIGS. 34A-34D, BBz CAR T cells show elevated levels of oxygen consumption and spare respiratory capacity. FIG. 34A shows the effects of antigen stimulation on mean cell volume after stimulation of CD19 CAR CD8+ T cells expressing 28z and BBz signaling domains with anti-idiotype. As shown in this figure, 28z and BBz CAR T cells have comparable mean cell sizes as measured on Days 0, 7 and 20. FIG. 34B shows the oxygen consumption rates (OCRs) of 28z and BBz CAR T cells at baseline (after electroporation of CAR mRNA and before stimulation) on day 0 and after stimulation on days 7 and 21 in culture under basal conditions and in response to mitochondrial inhibitors, as specified in Example 6. Basal OCR levels (FIG. 34C), basal OCR/ECAR ratio (FIG. 34D), maximum respiratory levels (FIG. 34F), and basal ECAR levels (FIG. 34G) measured at Day 7 and Day 21 (revealing preferential elevation of OXPHOS in BBz CAR T cells). Data are representative of at least five independent experiments performed with cells from at least five healthy human donors plotted as mean±SEM (*, $p<0.05$). FIG. 34E shows relative mRNA expression levels of genes involved in glycolytic metabolism and lipid oxidation assessed in 28z and BBz, CAR T cells. Plot represents data from at least three independent experiments with cells obtained from four independent donors (**, $p<0.01$; *, $p<0.05$). Data are represented as mean±SEM. FIGS. 34H-34J show basal OCR levels measured for CAR T cells sorted for different memory phenotypes: central memory (CM; FIG. 34H), naive (N; FIG. 34I), and effector memory (EM; FIG. 34J). Data are representative of at least three independent experiments performed with cells from at least three healthy human donors and plotted as mean±SEM. FIG. 34K shows basal ECAR levels measured for the three different sorted memory subsets. Data are representative of at least three independent experiments performed with cells from at least three healthy human donors plotted as mean±SEM (*, $p<0.05$). FIG. 34L shows the measurement of glucose uptake from extracellular media and lactate release into the media over a course of 48 hr. FIG.

34M shows the percentage of labeled acetyl-CoA measured in T cells cultured with [$^{13}C_{16}$] palmitic acid to assess fatty acid uptake and breakdown.

Figure 35A:
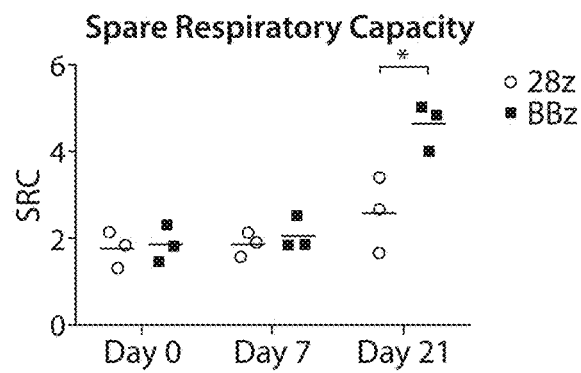
Figure 35B:
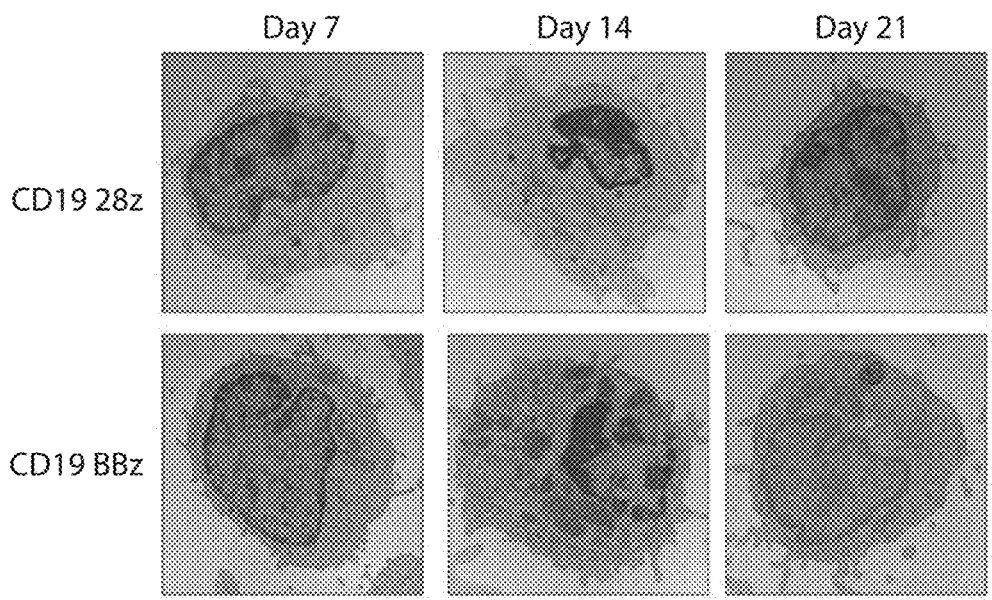
Figure 35C:
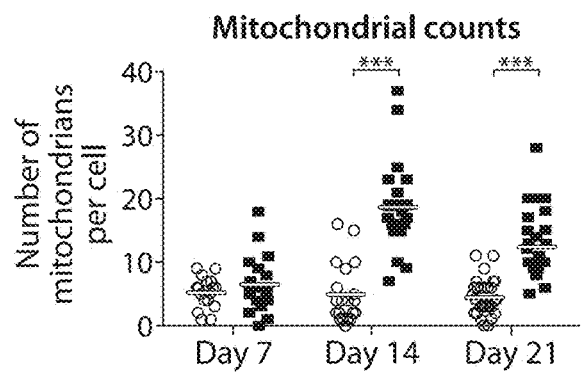

FIGS. 35A-35C show that BBz CAR T cells show enhanced spare respiratory capacity (SRC). FIG. 35A shows SRC measured as the ratio between the maximum OCR levels after treating cells with FCCP to the basal OCR levels at steady state while in culture. Data represents three independent donors tested ($*p<0.05$). FIG. 35B shows transmission electron microscopy of 28z and BBz CAR CD8+ T cells imaged at three different time point. Scale bars represent 2 μm. FIG. 35C shows enumeration of the individual mitochondrion per cell. Data shown 20 individual randomly chosen cells (out of at least 75 cells analyzed per condition) represented as mean±SEM (***, $p<0.001$).

Figure 36A:
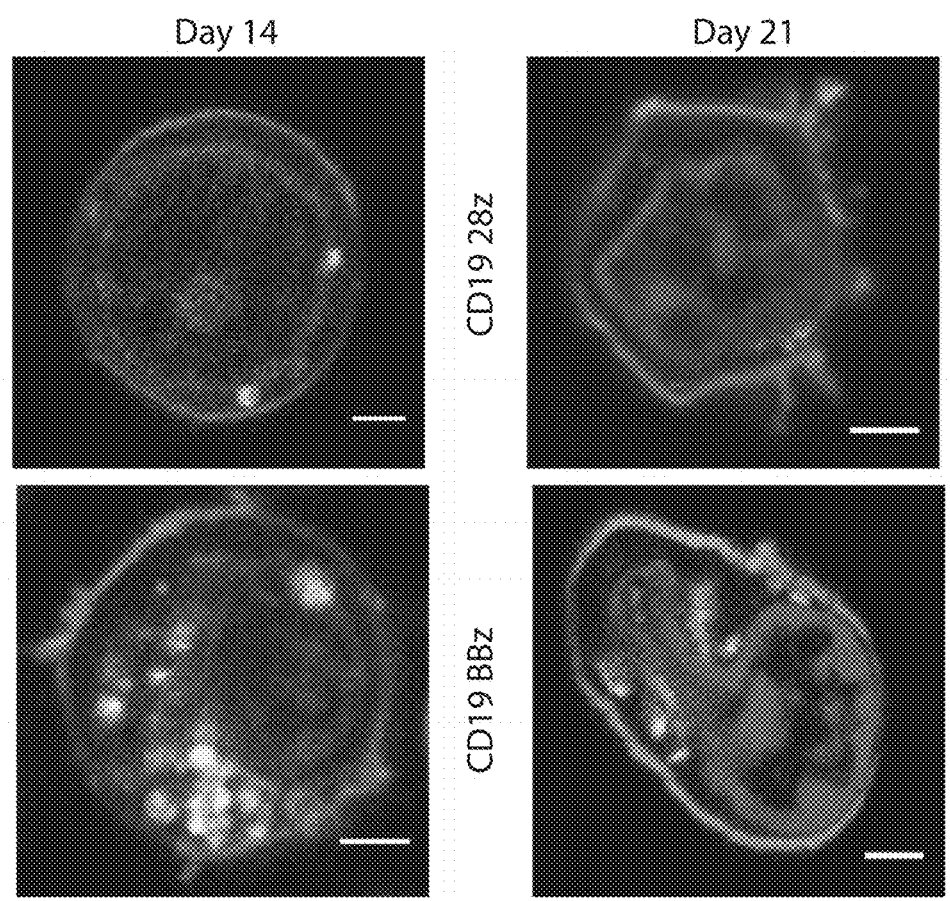
Figure 36B:
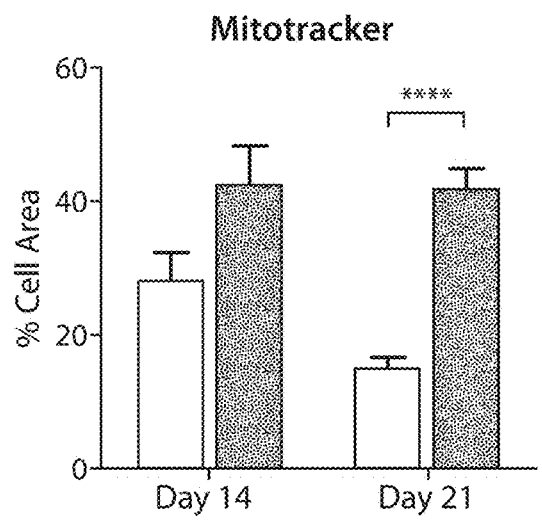
Figure 36C:
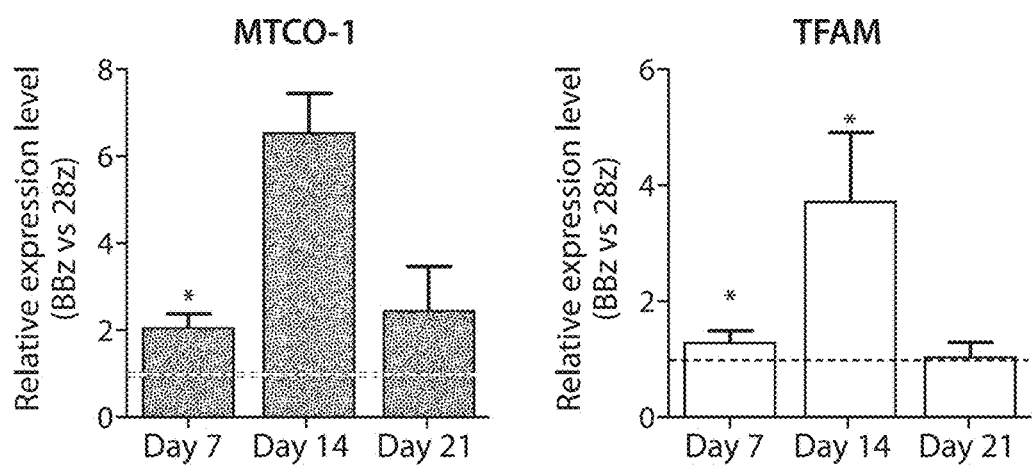
Figure 36D:
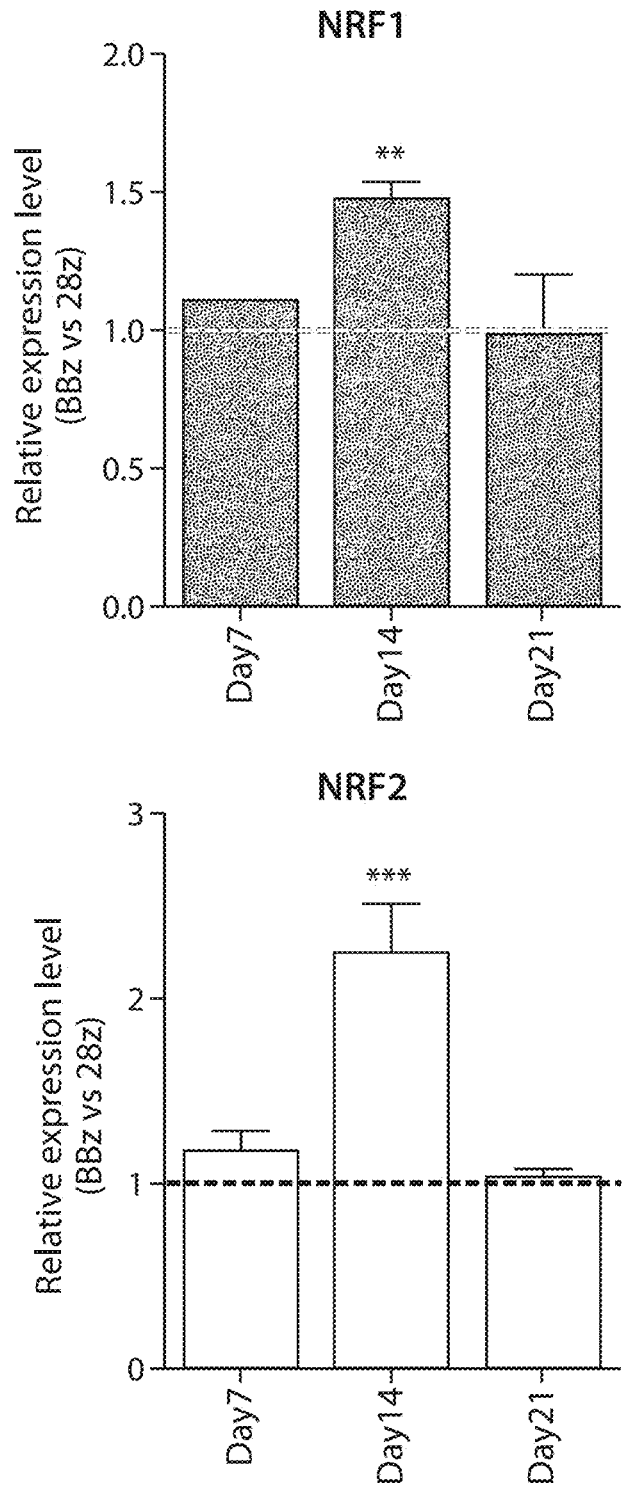

FIGS. 36A-36D show BBz CAR signaling imprints genetic alterations of T cell to enhance mitochondrial biogenesis. FIG. 36A shows confocal images stained with Mitotracker (green), DAPI (blue) and a cell-membrane dye DiI (red). Scale bars represent 2 μm. FIG. 36B shows quantification of the percentage of cytoplasm occupied by mitochondria, measured as percentage of Mitotracker (green) within area enclosed the cell membrane (red). Data represented as mean±SEM from at least three images each at specified time points with at least 15 independent cells scored per image. (****, $p<0.0001$). FIG. 36C shows relative mRNA expression of mitochondrial cytochrome c oxidase 1 (MT-CO1) and mitochondrial transcription factor A (TFAM) in BBz CAR T cells normalized to expression levels of 28z CAR T cells at specified time points. Data generated from at least three independent experiments with four independent donors (*, $p<0.05$), represented as mean±SEM. FIG. 36D shows normalized mRNA expression levels of nuclear respiratory factor 1 (NRF1) and GA binding protein (NRF2) in BBz CAR T cells in comparison to 28z CAR T cells at specified time points. Data are generated from at least three independent experiments with four independent donors (*, $p<0.05$) and represented as mean±SEM.

Figure 37:
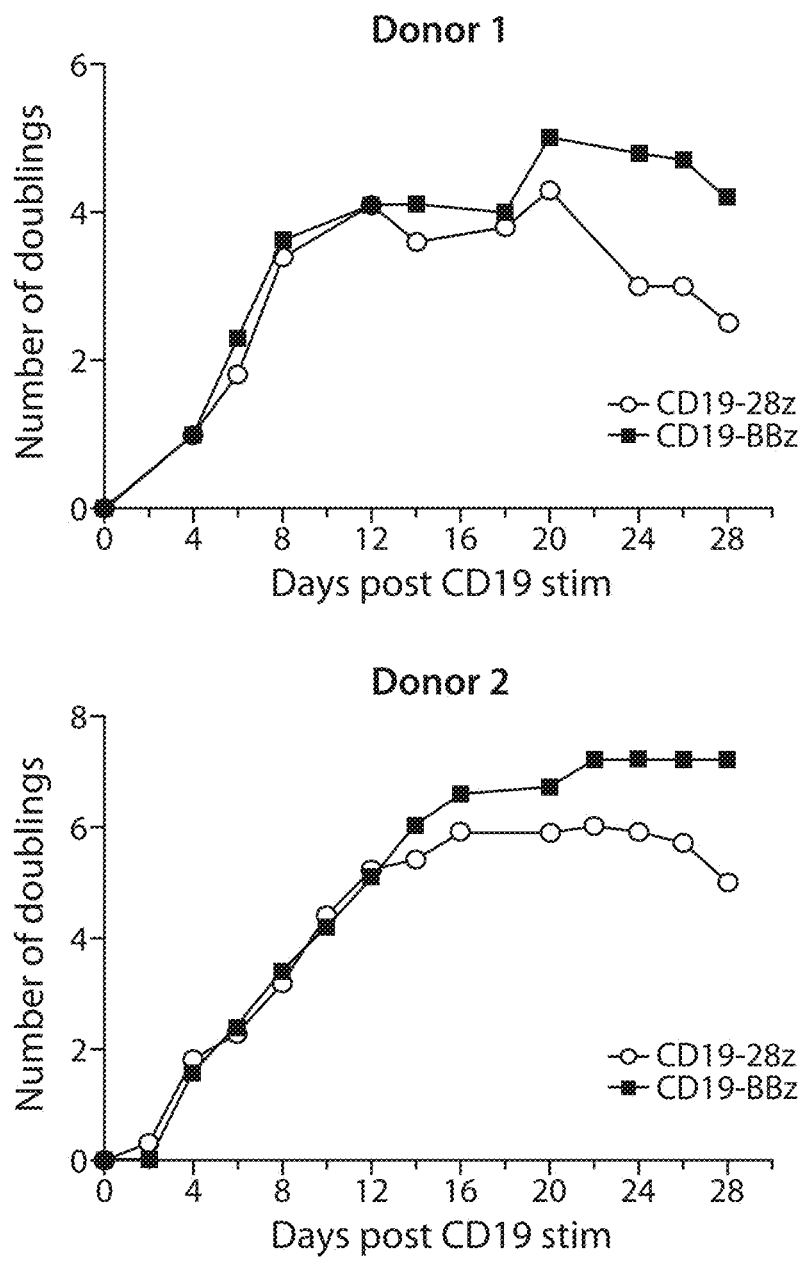

FIG. 37 shows expansion profiles of CD19-28z and CD19-BBz CAR T cells for two other independent donors. It is consistently observed that BBz CAR T cells continue to proliferate and survive longer in culture.

Figure 38:
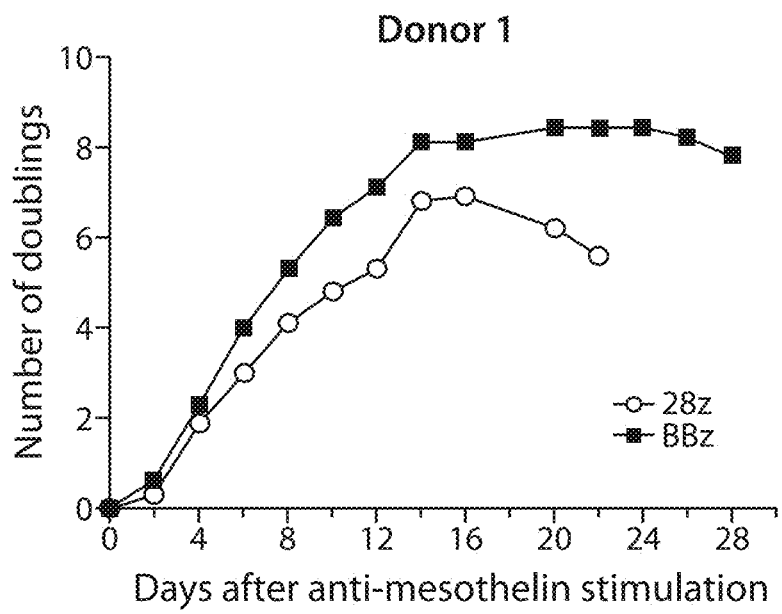
Figure 38:
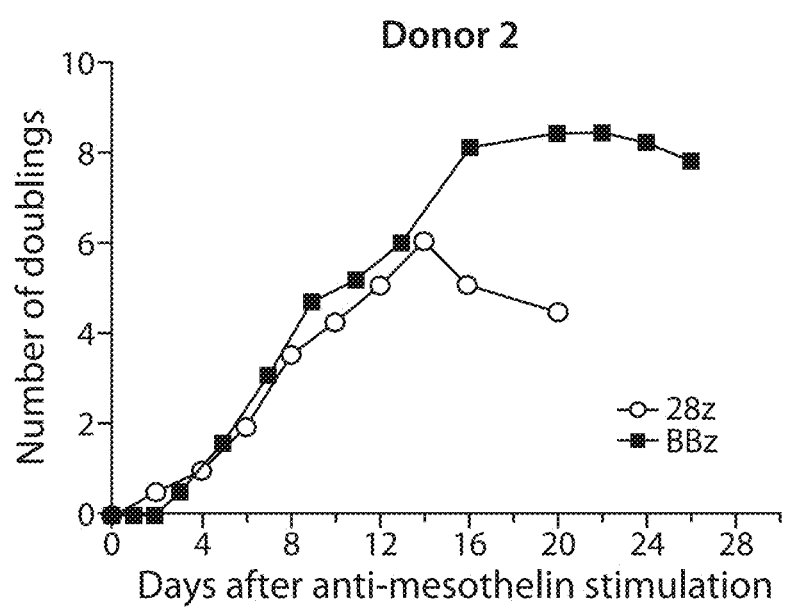

FIG. 38 shows expansion profiles of mesothelin-specific CAR T cells for two other independent donors. It is consistently observed that BBz CAR T cells continue to proliferate and survive longer in culture.

Figure 39:
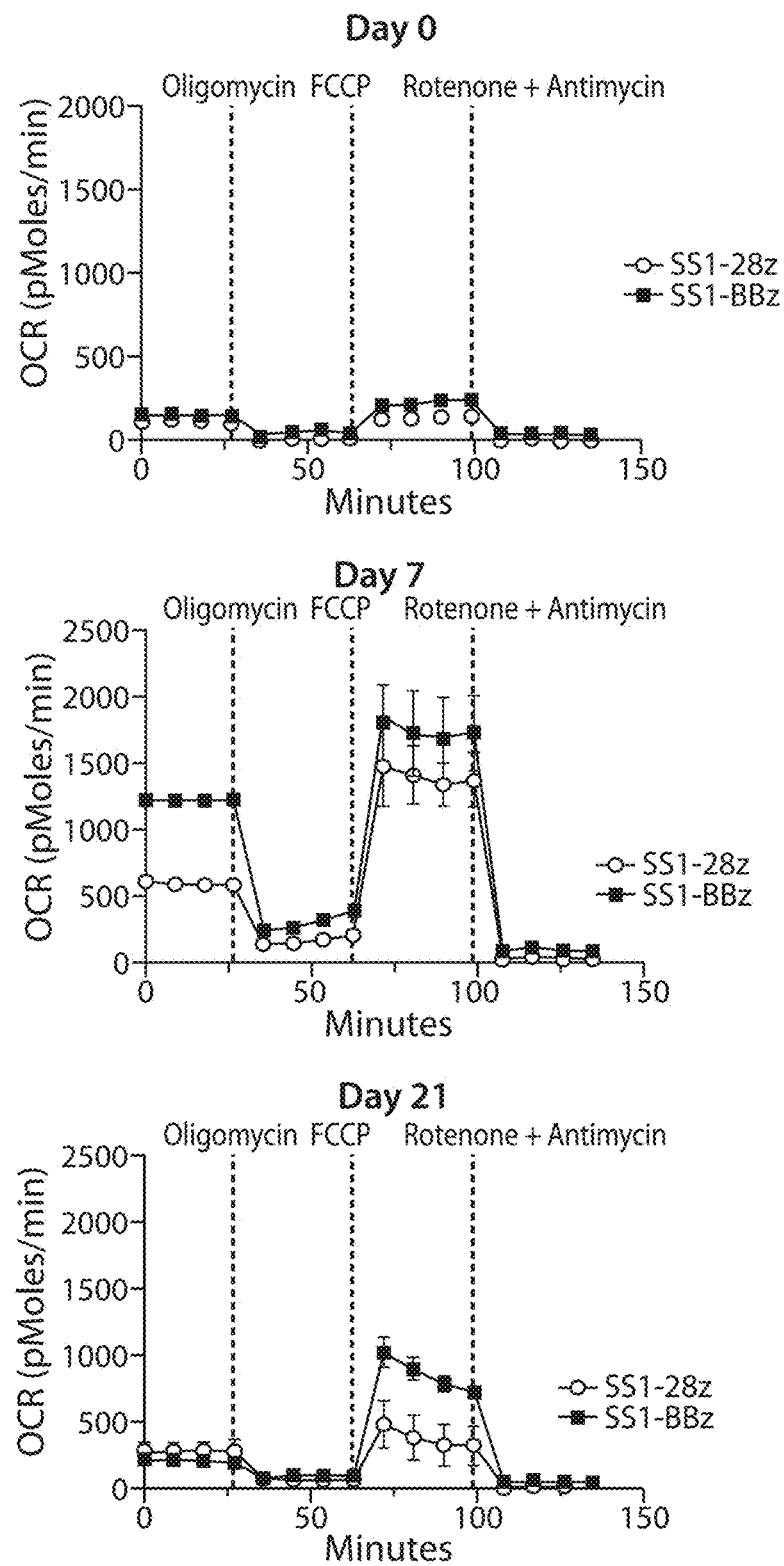

FIG. 39 shows the oxygen consumption rates (OCR) on 28z and BBz CAR T cells before stimulation (day 0) and on days 7 and 21 in culture, under basal conditions and in to the presence of mitochondrial inhibitors as specified in Example 6. Metabolic assays performed on mesothelin-specific CARs reveal higher oxygen consumption rates in BBz-CAR stimulated cells.

Figure 40:
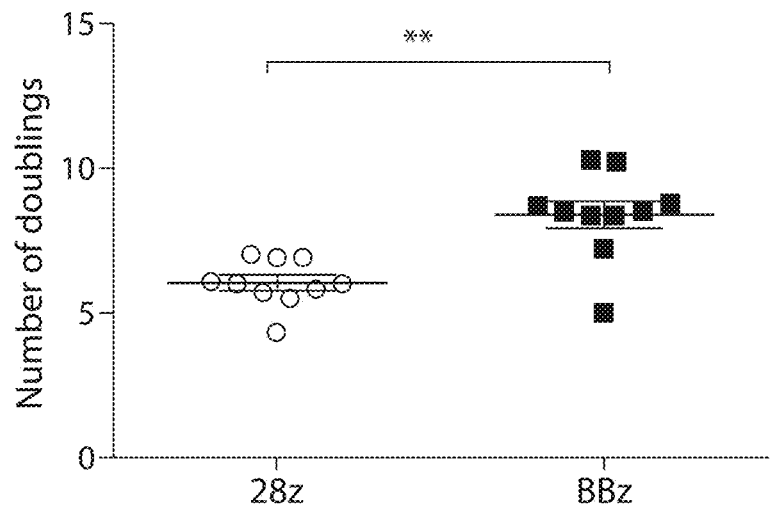
Figure 40:
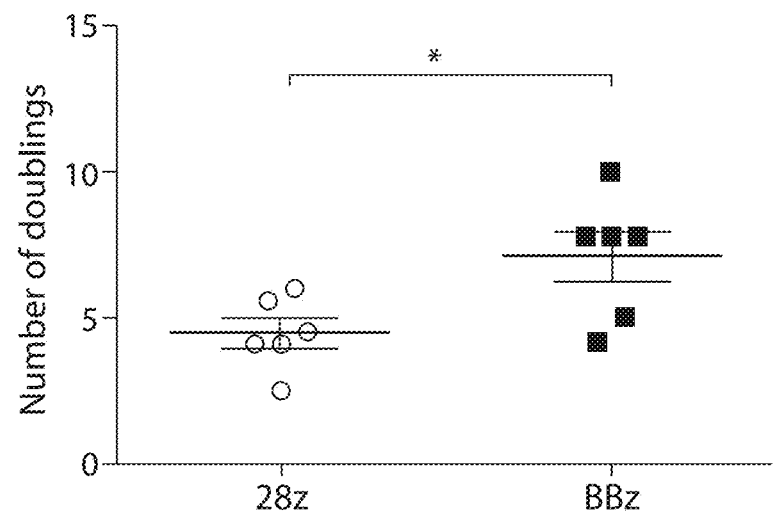

FIG. 40 shows total population doublings between the two CAR constructs (CD19 CAR n=10, $p**=<0.01$, Mesothelin CAR n=6, $p*=<0.05$), as shown in FIGS. 37 and 38. CD19 or SS1 CAR T cells were stimulated with anti-idiotype antibody to the CD19 scFv or mesothelin-Fc immobilized on beads, respectively.

Figure 41:
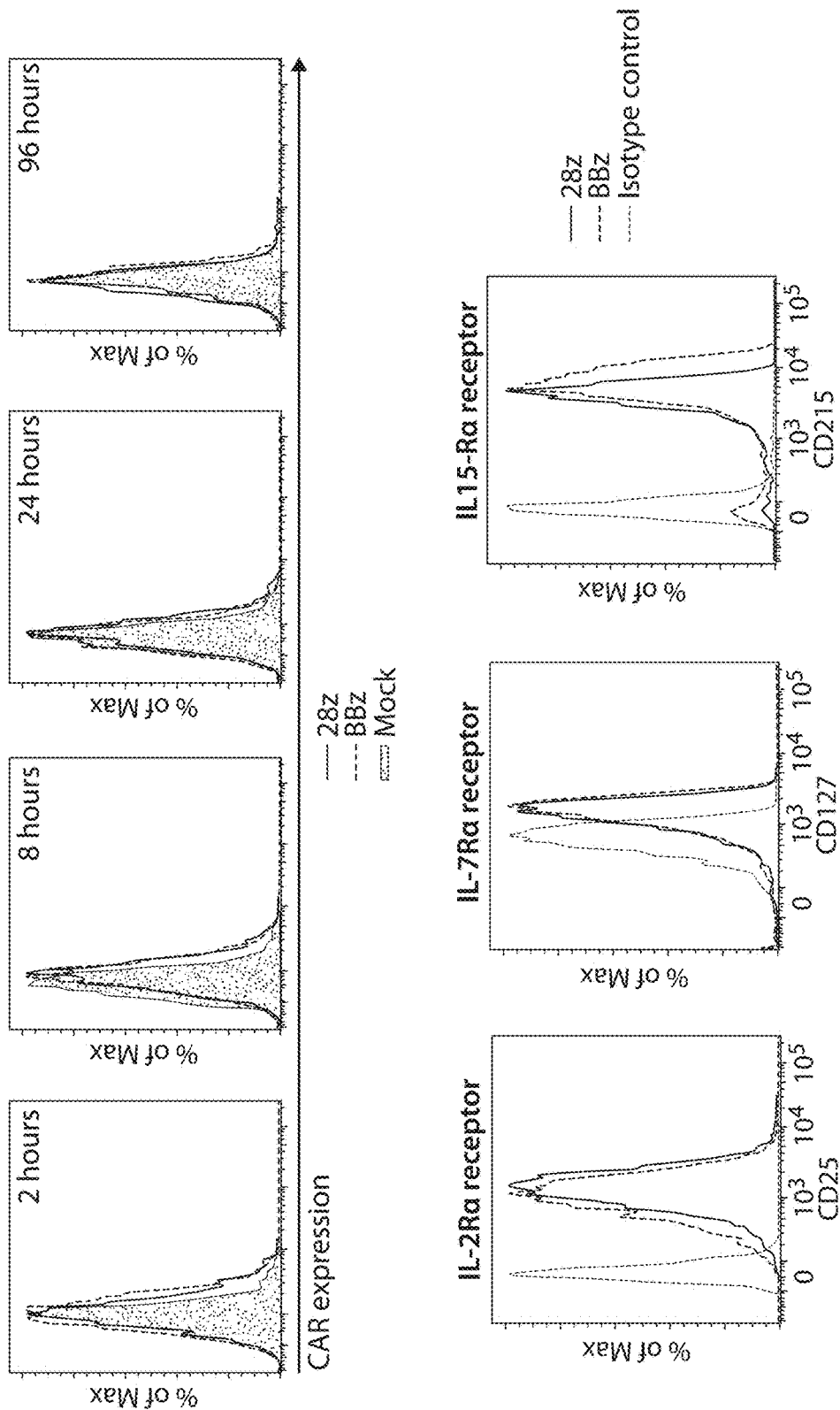

FIG. 41 shows CAR and key cytokine receptor expression levels on cell surface post antigen exposure. The top panel shows the lack of any detectable CAR expression levels on the surface of T cells post engagement with anti-idiotype antibody to the CD19 scFv immobilized on beads. These plots represent the same cell populations which were assayed in FIG. 32B that expressed CARs prior to antigenic stimulation. Bottom panel shows levels of cytokine receptors, IL-2Rα, IL-7Rα and IL-15Rα on cell surface as assayed by flow cytometry.

Figure 42:
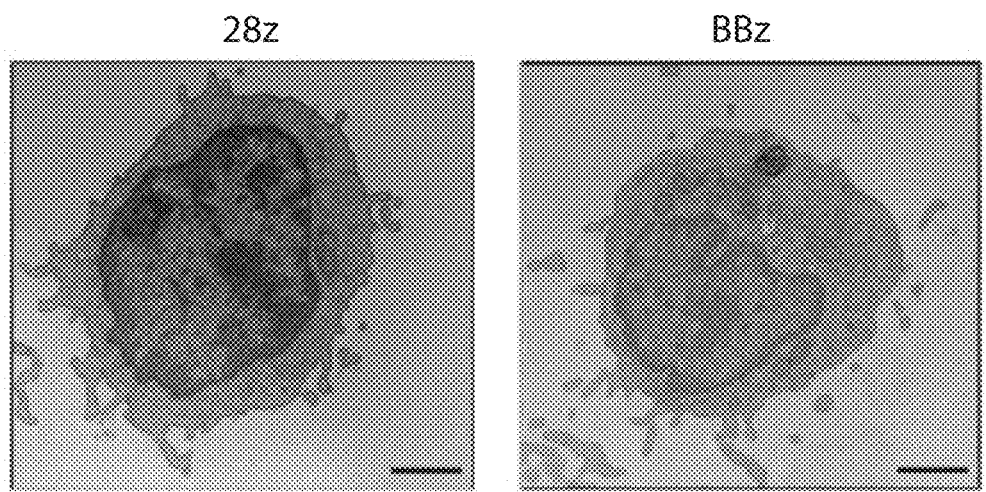

FIG. 42 shows changes in mitochondrial content in 28z and BBz CAR T cells as measured on Day 21. Transmission electron microscopy of representative 28z and BBz CAR CD8+ T cells imaged at Day 21. Scale bars represent 2 μm.

DETAILED DESCRIPTION

The methods described herein are based, at least in part, on the discovery that activation of a CAR expressed (e.g., transiently expressed) on an immune effector cell surface provides an effective means for expanding and/or activating a population of immune effector cells. As described herein, activation of a CAR on the surface of an immune effector cell by its cognate antigen or an anti-idiotypic antibody can result in cell expansion. In some embodiments, such cell expansion can be achieved without substantially altering the genotype or phenotype of the cell by transiently expressing the CAR (e.g., by in vitro transcribed RNA). The methods described herein provide significant advantages over previously used methods for immune effector cell expansion.

In addition to being used to expand primary human T cells, methods described herein can be used in the expansion of specific subsets of T lymphocytes, including naïve cells, T-regulatory cell, Th-17 cells, anergized T cells, and stem cell T cells or cord blood cells. Without wishing to be bound by a particular theory, the method and compositions described herein provide an improvement over the conventional system, as repeated stimulations through the TCR can be lethal to antigen-inexperienced T cells. Single stimulation through transiently expressed surface receptor could avoid this issue. Furthermore, methods provided herein allow for T cells without disturbing the TCR for immunotherapy leading to less rapid differentiation and promoting "young" T cells in the culture. In other embodiments, the methods described herein enable high efficiency transduction using vectors, such as lentiviral vectors.

Advantageously, other cell types can be expanded that lack a T cell receptor or have T cell receptor with reduced function. For example, any type of hematopoietic stem cell can be expanded without alteration of their phenotype, and anergized T cells, TH17, NK, NKT and B cells can be expanded.

Viral-mediated gene transfer systems are being extensively used for pre-clinical and clinical immunotherapy studies. Current methods for viral-mediated gene transfer into T lymphocytes require activation of the cells, followed by addition of the viral vector. This activation is again traditionally accomplished by stimulating through the TCR. The methods of CAR-based stimulation described herein can be used to achieve high efficiency transduction with vectors such as lentiviral vectors. By stimulating through a transiently expressed CAR to achieve initial activation, the cells can be transduced with a lentiviral vector encoding the same or different CAR constructs.

In embodiments, the methods described herein provide for in vitro expansion of immune effector cells. In further embodiments, the methods described herein provide for in vivo expansion of T cells following lymph node injection or in vivo expansion of TILs following injection into a tumor.

Accordingly, in embodiments, the methods disclosed herein provide for methods of expanding a population of immune effector cells by contacting the population of immune effector cells with a nucleic acid encoding a CAR, under conditions suitable for transient expression of the CAR, wherein the CAR targets a cognate antigen molecule; and culturing the population of immune effector cells in the presence of the cognate antigen molecule. In one embodiment, the nucleic acid is RNA, e.g., in vitro transcribed RNA. In another embodiment, the cognate antigen molecule is a cancer associated antigen molecule. In one embodiment, the cognate antigen molecule is attached to a substrate, e.g., a bead, and the immune effector cell population is expanded in vitro. In another embodiment, the cognate antigen is expressed on a cell, e.g., a tumor cell and the immune effector cell population is expanded in vivo. In another aspect the invention features a method of treating, or providing anti-tumor immunity to, a subject having a cancer, comprising administering to the subject an effective amount of an immune effector cell population, wherein the immune effector cell population is expanded by methods described herein.

Definitions

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

"Acquire" or "acquiring" as the terms are used herein, refer to obtaining possession of a physical entity (e.g., a sample, a cell or cell population, a polypeptide, a nucleic acid, or a sequence), or a value, e.g., a numerical value, by "directly acquiring" or "indirectly acquiring" the physical entity or value. In one embodiment, acquiring refers to obtaining or harvesting a cell or cell population (e.g., an immune effector cell or population as described herein). "Directly acquiring" means performing a process (e.g., performing a synthetic or analytical or purification method) to obtain the physical entity or value. "Indirectly acquiring" refers to receiving the physical entity or value from another party or source (e.g., a third party laboratory that directly acquired the physical entity or value). Directly acquiring a physical entity includes performing a process that includes a physical change in a physical substance, e.g., a starting material. Exemplary changes include making a physical entity from two or more starting materials, shearing or fragmenting a substance, separating or purifying a substance, combining two or more separate entities into a mixture, performing a chemical reaction that includes breaking or forming a covalent or non-covalent bond. Directly acquiring a value includes performing a process that includes a physical change in a sample or another substance, e.g., performing an analytical process which includes a physical change in a substance, e.g., a sample, analyte, or reagent (sometimes referred to herein as "physical analysis"), performing an analytical method, e.g., a method which includes one or more of the following: separating or purifying a substance, e.g., an analyte, or a fragment or other derivative thereof, from another substance; combining an analyte, or fragment or other derivative thereof, with another substance, e.g., a buffer, solvent, or reactant; or changing the structure of an analyte, or a fragment or other derivative thereof, e.g., by breaking or forming a covalent or non-covalent bond, between a first and a second atom of the analyte; or by changing the structure of a reagent, or a fragment or other derivative thereof, e.g., by breaking or forming a covalent or non-covalent bond, between a first and a second atom of the reagent.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some embodiments, the set of polypeptides are in the same polypeptide chain (e.g., comprise a chimeric fusion protein). In some embodiments, the set of polypeptides are not contiguous with each other, e.g., are in different polypeptide chains. In some embodiments, the set of polypeptides are not contiguous with each other, e.g., are in different polypeptide chains. In some embodiments, the set of polypeptides include a dimerization switch that, upon the presence of a dimerization molecule, can couple the polypeptides to one another, e.g., can couple an antigen binding domain to an intracellular signaling domain. In one aspect, the stimulatory molecule is the zeta chain associated with the T cell receptor complex. In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule of the CAR is chosen from the costimulatory molecules described herein, e.g., 4-1BB (i.e., CD137), CD27, ICOS, and/or CD28. In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

"CAR molecule", depending on the context, refers to a CAR (e.g., a CAR polypeptide), a nucleic acid encoding a CAR, or both.

A CAR that comprises an antigen binding domain (e.g., a scFv, or TCR) that targets a specific tumor antigen X, such as those described herein, is also referred to as XCAR. For example, a CAR that comprises an antigen binding domain that targets CD19 is referred to as CD19CAR.

The term "signaling domain" refers to the functional portion of a protein which acts by transmitting information within the cell to regulate cellular activity via defined signaling pathways by generating second messengers or functioning as effectors by responding to such messengers.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab')$_2$, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide minibodies).

The term "inhibiton" or "inhibitor" includes a reduction in a certain parameter, e.g., an activity, of a given molecule, e.g., CD19, CD20, CD10, CD22, CD34, CD123, FLT-3, ROR1, CD79b, CD179b, mesothelin, or CD79a. For example, inhibition of an activity, e.g., an activity of CD20, CD10, CD19, CD22, CD34, CD123, FLT-3, ROR1, CD79b, CD179b, mesothelin, or CD79a, of at least 5%, 10%, 20%, 30%, 40%, or more is included by this term. Thus, inhibition need not be 100%. Activities for the inhibitors can be determined as described herein or by assays known in the art.

As used herein, the term "CD10" refers to an antigenic determinant known to be detectable on leukemia cells. The human and murine amino acid and nucleic acid sequences can be found in a public database, such as GenBank, UniProt and Swiss-Prot. For example, the amino acid sequences of human CD10 can be found at Accession Nos. NP_009218.2; NP_000893.2; NP_009219.2; NP_009220.2, and the mRNA sequences encoding them can be found at Accession Nos. NM_007287.2 (variant 1bis); NM_000902.3 (variant 1); NM_007288.2 (variant 2a); NM_007289.2 (variant 2b). In one aspect the antigen-binding portion of the CAR recognizes and binds an antigen within the extracellular domain of the CD10 protein. In one aspect, the CD10 protein is expressed on a cancer cell. As used herein, "CD10" includes proteins comprising mutations, e.g., point mutations, fragments, insertions, deletions and splice variants of full length wild-type CD10.

As used herein, the term "CD19" refers to the Cluster of Differentiation 19 protein, which is an antigenic determinant detectable on leukemia precursor cells. The human and murine amino acid and nucleic acid sequences can be found in a public database, such as GenBank, UniProt and Swiss-Prot. For example, the amino acid sequence of human CD19 can be found as UniProt/Swiss-Prot Accession No. P15391 and the nucleotide sequence encoding of the human CD19 can be found at Accession No. NM_001178098. As used herein, "CD19" includes proteins comprising mutations, e.g., point mutations, fragments, insertions, deletions and splice variants of full length wild-type CD19.

CD19 is expressed on most B lineage cancers, including, e.g., acute lymphoblastic leukaemia, chronic lymphocyte leukaemia and non-Hodgkin lymphoma. Other cells with express CD19 are provided below in the definition of "disease associated with expression of CD19." It is also an early marker of B cell progenitors. See, e.g., Nicholson et al. Mol. Immun. 34 (16-17): 1157-1165 (1997). In one aspect the antigen-binding portion of the CART recognizes and binds an antigen within the extracellular domain of the CD19 protein. In one aspect, the CD19 protein is expressed on a cancer cell.

As used herein, the term "CD20" refers to an antigenic determinant known to be detectable on B cells. Human CD20 is also called membrane-spanning 4-domains, subfamily A, member 1 (MS4A1). The human and murine amino acid and nucleic acid sequences can be found in a public database, such as GenBank, UniProt and Swiss-Prot. For example, the amino acid sequence of human CD20 can be found at Accession Nos. NP_690605.1 and NP_068769.2, and the nucleotide sequence encoding transcript variants 1 and 3 of the human CD20 can be found at Accession No. NM_152866.2 and NM_021950.3, respectively. In one aspect the antigen-binding portion of the CAR recognizes and binds an antigen within the extracellular domain of the CD20 protein. In one aspect, the CD20 protein is expressed on a cancer cell. As used herein, "CD20" includes proteins comprising mutations, e.g., point mutations, fragments, insertions, deletions and splice variants of full length wild-type CD20.

As used herein, the terms "CD22," refers to an antigenic determinant known to be detectable on leukemia precursor cells. The human and murine amino acid and nucleic acid sequences can be found in a public database, such as GenBank, UniProt and Swiss-Prot. For example, the amino acid sequences of isoforms 1-5 human CD22 can be found at Accession Nos. NP 001762.2, NP 001172028.1, NP 001172029.1, NP 001172030.1, and NP 001265346.1, respectively, and the nucleotide sequence encoding variants 1-5 of the human CD22 can be found at Accession No. NM 001771.3, NM 001185099.1, NM 001185100.1, NM 001185101.1, and NM 001278417.1, respectively. In one aspect the antigen-binding portion of the CAR recognizes and binds an antigen within the extracellular domain of the CD22 protein. In one aspect, the CD22 protein is expressed on a cancer cell. As used herein, "CD22" includes proteins comprising mutations, e.g., point mutations, fragments, insertions, deletions and splice variants of full length wild-type CD22.

As used herein, the term "CD34" refers to an antigenic determinant known to be detectable on hematopoietic stem cells and some cancer cells. The human and murine amino acid and nucleic acid sequences can be found in a public database, such as GenBank, UniProt and Swiss-Prot. For example, the amino acid sequences of human CD34 can be found at Accession Nos. NP_001020280.1 (isoform a precursor); NP_001764.1 (isoform b precursor), and the mRNA sequences encoding them can be found at Accession Nos. NM_001025109.1 (variant 1); NM_001773.2 (variant 2). In one aspect the antigen-binding portion of the CAR recognizes and binds an antigen within the extracellular domain of the CD34 protein. In one aspect, the CD34 protein is expressed on a cancer cell. As used herein, "CD34" includes proteins comprising mutations, e.g., point mutations, fragments, insertions, deletions and splice variants of full length wild-type CD34.

As used herein, the term "CD123" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD123 can be found at Accession Nos. NP_002174.1 (isoform 1 precursor); NP_001254642.1 (isoform 2 precursor), and the mRNA sequences encoding them can be found at Accession Nos. NM_002183.3 (variant 1); NM_001267713.1 (variant 2). In one aspect the antigen-binding portion of the CAR recognizes and binds an antigen within the extracellular domain of the CD123 protein. In one aspect, the CD123 protein is expressed on a cancer cell. As used herein, "CD123" includes proteins comprising mutations, e.g., point mutations, fragments, insertions, deletions and splice variants of full length wild-type CD123.

As used herein, the term "CD79b" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD79b can be found at Accession Nos. NP_000617.1 (isoform 1 precursor), NP_067613.1 (isoform 2 precursor), or NP_001035022.1 (isoform 3 precursor), and the mRNA sequences encoding them can be found at Accession Nos. NM_000626.2 (transcript variant 1), NM_021602.2 (transcript variant 2), or NM_001039933.1 (transcript variant 3). In one aspect the antigen-binding portion of the CAR recognizes and binds an antigen within the extracellular domain of the CD79b protein. In one aspect, the CD79b protein is expressed on a cancer cell. As used herein, "CD79b" includes proteins comprising mutations, e.g., point mutations, fragments, insertions, deletions and splice variants of full length wild-type CD79b.

As used herein, the term "CD79a" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD79a can be found at Accession Nos. NP_001774.1 (isoform 1 precursor) or NP_067612.1 (isoform 2 precursor), and the mRNA sequences encoding them can be found at Accession Nos. NM_001783.3 (transcript variant 1) or NM_021601.3 (transcript variant 2). In one aspect, the antigen-binding portion of the CAR recognizes and binds an antigen within the extracellular domain of the CD79a protein. In one aspect, the CD79a protein is expressed on a cancer cell. As used herein, "CD79a" includes proteins comprising mutations, e.g., point mutations, fragments, insertions, deletions and splice variants of full length wild-type CD79a.

As used herein, the term "CD179b" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD179b can be found at Accession Nos. NP_064455.1 (isoform a precursor) or NP_690594.1 (isoform b precursor), and the mRNA sequences encoding them can be found at Accession Nos. NM_020070.3 (transcript variant 1) or NM_152855.2 (transcript variant 2). In one aspect the antigen-binding portion of the CAR recognizes and binds an antigen within the extracellular domain of the CD179b protein. In one aspect, the CD179b protein is expressed on a cancer cell. As used herein, "CD179b" includes proteins comprising mutations, e.g., point mutations, fragments, insertions, deletions and splice variants of full length wild-type CD179b.

As used herein, the term "FLT-3" refers to an antigenic determinant known to be detectable on hematopoietic progenitor cells and some cancer cells, e.g., leukemia cells. The human and murine amino acid and nucleic acid sequences can be found in a public database, such as GenBank, UniProt and Swiss-Prot. For example, the amino acid sequences of human FLT-3 can be found at Accession Nos. NP_004110.2, and the mRNA sequences encoding them can be found at Accession Nos. NM_004119.2. In one aspect the antigen-binding portion of the CAR recognizes and binds an antigen within the extracellular domain of the FLT-3 protein. In one aspect, the FLT-3 protein is expressed on a cancer cell. As used herein, "FLT-3" includes proteins comprising mutations, e.g., point mutations, fragments, insertions, deletions and splice variants of full length wild-type FLT-3.

As used herein, the term "ROR1" refers to an antigenic determinant known to be detectable on leukemia precursor cells. The human and murine amino acid and nucleic acid sequences can be found in a public database, such as GenBank, UniProt and Swiss-Prot. For example, the amino acid sequences of isoforms 1 and 2 precursors of human ROR1 can be found at Accession Nos. NP_005003.2 and NP_001077061.1, respectively, and the mRNA sequences encoding them can be found at Accession Nos. NM_005012.3 and NM_001083592.1, respectively. In one aspect the antigen-binding portion of the CAR recognizes and binds an antigen within the extracellular domain of the ROR1 protein. In one aspect, the ROR1 protein is expressed on a cancer cell. As used herein, "ROR1" includes proteins comprising mutations, e.g., point mutations, fragments, insertions, deletions and splice variants of full length wild-type ROR1.

As used herein, the term "mesothelin" refers to the 40-kDa protein, mesothelin, which is anchored at the cell membrane by a glycosylphosphatidyl inositol (GPI) linkage and an amino-terminal 31-kDa shed fragment, called megkaryocyte potentiating factor (MPF). Both fragments contain N-glycosylation sites. The term also refers to a soluble splice variant of the 40-kDa carboxyl-terminal fragment also called "soluble mesothelin/MPF-related". Preferably, the term refers to a human mesothelin of GenBank accession number AAH03512.1, and naturally cleaved portions thereof, e.g., as expressed on a cell membrane, e.g., a cancer cell membrane. As used herein, "mesothelin" includes proteins comprising mutations, e.g., point mutations, fragments, insertions, deletions and splice variants of full length wild-type mesothelin.

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The portion of a CAR comprising an antibody or antibody fragment thereof may exist in a variety of forms where the antigen binding domain is expressed as part of a contiguous polypeptide chain including, for example, a single domain antibody fragment (sdAb), a single chain antibody (scFv) and a humanized antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one embodiment, the antigen binding domain of a CAR comprises an antibody fragment. In a further embodiment, the CAR comprises an antibody fragment that comprises a scFv. As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The term "complementarity determining region" or "CDR," as used herein, refers to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273,927-948 ("Chothia" numbering scheme), or a combination thereof. Under the Kabat numbering scheme, in some embodiments, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under the Chothia numbering scheme, in some embodiments, the CDR amino acids in the VH are numbered 26-32 (HCDR1), 52-56 (HCDR2), and 95-102 (HCDR3); and the CDR amino acid residues in the VL are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a VH, e.g., a mammalian VH, e.g., a human VH; and amino acid residues 24-34 (LCDR1), 50-56 (LCDR2), and 89-97 (LCDR3) in a VL, e.g., a mammalian VL, e.g., a human VL.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody, or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen," "Ag," or "antigen molecule" refers to a molecule that provokes an immune response. This immune response may involve either antibody production, or the activation of specific immunologically-competent cells, or both. In some embodiments, an antigen is any macromolecule, including all proteins or peptides. In other embodiments, antigens are derived from recombinant or genomic DNA. Any DNA, which comprises nucleotide sequences or a partial nucleotide sequence encoding a protein that elicits an immune response therefore encodes an "antigen" as that term is used herein. An antigen need not be encoded solely by a full length nucleotide sequence of a gene. In embodiments, antigens include, but are not limited to, the use of partial nucleotide sequences of more than one gene and that these nucleotide sequences are arranged in various combinations to encode polypeptides that elicit the desired immune response. In an embodiment, an antigen need not be encoded by a "gene" at all. In one embodiment, an antigen can be generated synthesized or can be derived from a biological sample, or might be macromolecule besides a polypeptide. Such a biological sample can include, but is not limited to a tissue sample, a tumor sample, a cell or a fluid with other biological components. In embodiments, antigens include, for example, carbohydrates (e.g., monosaccharides, disaccharides, oligosaccharides, and polysaccharides).

The term "cognate antigen molecule" refers to any antigen described herein. In one embodiment, it refers to an antigen recognized, e.g., targeted, by a CAR molecule, e.g., any CAR described herein. In another embodiment, it refers to a cancer associated antigen described herein. In one embodiment, the cognate antigen molecule is a recombinant molecule.

The term "anti-idiotypic (or idiotype) antibody molecule" or "anti-antigen idiotypic (idiotype) antibody molecule" refers to an antibody molecule that binds to an antibody, e.g., the antigen-binding site or the variable region of an antibody. In one embodiment, the anti-idiotypic antibody molecule binds to an epitope of an antibody that is in contact with the antigen, e.g., an antigen as described herein (e.g., a cognate antigen molecule as described herein). In one embodiment, the anti-idiotypic antibody molecule binds to the CAR antigen binding domain, e.g., the portion of the CAR comprising an antibody or antibody fragment (e.g., the antigen binding portion of the CAR).

The term "ligand of a CAR molecule" as used herein refers to a molecule that binds to a CAR molecule or a portion of a CAR molecule. In one embodiment, a ligand binds to the CAR antigen binding domain, e.g., the portion of the CAR comprising an antibody or antibody fragment. In one embodiment, the ligand is an antigen molecule, e.g., a cognate antigen molecule, e.g., as described herein. In another embodiment, the ligand is an anti-idiotypic antibody molecule, e.g., an anti-antigen (e.g., CD19) idiotypic antibody molecule as described herein.

The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically The term "xenogeneic" refers to any material derived from an animal of a different species.

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of a tumor antigen" as described herein includes, but is not limited to, a disease associated with expression of a tumor antigen as described herein or condition associated with cells which express a tumor antigen as described herein including, e.g., proliferative diseases such as a cancer or malignancy or a precancerous condition such as a myelodysplasia, a myelodysplastic syndrome or a preleukemia; or a noncancer related indication associated with cells which express a tumor antigen as described herein. In one embodiment, a cancer associated with expression of a tumor antigen as described herein is a hematological cancer. In one embodiment, a cancer associated with expression of a tumor antigen as described herein is a solid cancer. Further diseases associated with expression of a tumor antigen as described herein include, but not limited to, e.g., atypical and/or non-classical cancers, malignancies, precancerous conditions or proliferative diseases associated with expression of a tumor antigen as described herein. Non-cancer related indications associated with expression of a tumor antigen as described herein include, but are not limited to, e.g., autoimmune disease, (e.g., lupus), inflammatory disorders (allergy and asthma) and transplantation. In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein.

The phrase "disease associated with expression of CD19" includes, but is not limited to, a disease associated with a cells that expresses CD19 (e.g., wild-type or mutant CD19) or condition associated with a cell which expresses, or at any time expressed, CD19 (e.g., wild-type or mutant CD19) including, e.g., proliferative diseases such as a cancer or malignancy or a precancerous condition such as a myelodysplasia, a myelodysplastic syndrome or a preleukemia; or a noncancer related indication associated with cells which express CD19. For the avoidance of doubt, a disease associated with expression of CD19 may include a condition associated with a cell which does not presently express CD19, e.g., because CD19 expression has been downregulated, e.g., due to treatment with a molecule targeting CD19, e.g., a CD19 CAR, but which at one time expressed CD19. In one aspect, a cancer associated with expression of CD19 is a hematological cancer. In one aspect, the hematolical cancer is a leukemia or a lymphoma. In one aspect, a cancer associated with expression of CD19 includes cancers and malignancies including, but not limited to, e.g., one or more acute leukemias including but not limited to, e.g., acute myeloid leukemia (AML), B-cell acute Lymphoid Leukemia (BALL), T-cell acute Lymphoid Leukemia (TALL), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of CD19 comprise, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma (MCL), Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, myeloproliferative neoplasm; a histiocytic disorder (e.g., a mast cell disorder or a blastic plasmacytoid dendritic cell neoplasm); a mast cell disorder, e.g., systemic mastocytosis or mast cell leukemia; B-cell prolymphocytic leukemia, plasma cell myeloma, and "preleukemia" which are a diverse collection of hematological conditions united by ineffective production (or dysplasia) of myeloid blood cells, and the like.

Further diseases associated with expression of CD19 expression include, but not limited to, e.g., atypical and/or non-classical cancers, malignancies, precancerous conditions or proliferative diseases associated with expression of CD19. Non-cancer related indications associated with expression of CD19 include, but are not limited to, e.g., autoimmune disease, (e.g., lupus), inflammatory disorders (allergy and asthma) and transplantation. In some embodiments, the CD19-expressing cells express, or at any time expressed, CD19 mRNA. In an embodiment, the CD19-expressing cells produce a CD19 protein (e.g., wild-type or mutant), and the CD19 protein may be present at normal levels or reduced levels. In an embodiment, the CD19-expressing cells produced detectable levels of a CD19 protein at one point, and subsequently produced substantially no detectable CD19 protein.

In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein. In other embodiments, the disease is a CD19-negative cancer, e.g., a CD19-negative relapsed cancer. In some embodiments, the tumor antigen (e.g., CD19)-expressing cell expresses, or at any time expressed, mRNA encoding the tumor antigen. In an embodiment, the tumor antigen (e.g., CD19)-expressing cell produces the tumor antigen protein (e.g., wild-type or mutant), and the tumor antigen protein may be present at normal levels or reduced levels. In an embodiment, the tumor antigen (e.g., CD19)-expressing cell produced detectable levels of a tumor antigen protein at one point, and subsequently produced substantially no detectable tumor antigen protein.

The term "relapse" as used herein refers to reappearance of a disease (e.g., cancer) after an initial period of responsiveness, e.g., after prior treatment with a therapy, e.g., cancer therapy (e.g., complete response or partial response). The initial period of responsiveness may involve the level of cancer cells falling below a certain threshold, e.g., below 20%, 15%, 10%, 5%, 4%, 3%, 2%, or 1%. The reappearance may involve the level of cancer cells rising above a certain threshold, e.g., above 20%, 15%, 10%, 5%, 4%, 3%, 2%, or 1%. For example, e.g., in the context of B-ALL, the reappearance may involve, e.g., a reappearance of blasts in the blood, bone marrow (>5%), or any extramedullary site, after a complete response. A complete response, in this context, may involve <5% BM blast. More generally, in an embodiment, a response (e.g., complete response or partial response) can involve the absence of detectable MRD (minimal residual disease). In an embodiment, the initial period of responsiveness lasts at least 1, 2, 3, 4, 5, or 6 days; at least 1, 2, 3, or 4 weeks; at least 1, 2, 3, 4, 6, 8, 10, or 12 months; or at least 1, 2, 3, 4, or 5 years.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR described herein can be replaced with other amino acid residues from the same side chain family and the altered CAR can be tested using the functional assays described herein.

The term "stimulation," refers to a primary response induced by binding of a stimulatory molecule (e.g., a TCR/CD3 complex or CAR) with its cognate ligand (e.g., antigen molecule), thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:9, or the equivalent residues from a non-human species, e.g., mouse, rodent, monkey, ape and the like. In a specific CAR of the invention, the primary signaling sequence of CD3-zeta is the sequence as provided in SEQ ID NO:10, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. The intracellular signaling domain can generate a signal that promotes an immune effector function of the CAR containing cell, e.g., a CART cell. Examples of immune effector function, e.g., in a CART cell, include cytolytic activity and helper activity, including the secretion of cytokines. In embodiments, the intracellular signaling domain is the portion of a protein which transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, CD278 ("ICOS"), FcεRI, CD66d, CD32, DAP10 and DAP12.

The term "zeta" or alternatively "zeta chain", "CD3-zeta" or "TCR-zeta" is defined as the protein provided as GenBank Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:9 (mutant CD3 zeta). In one aspect, the "zeta stimulatory domain" or a "CD3-zeta stimulatory domain" is the sequence provided as SEQ ID NO:10 (wild-type human CD3 zeta).

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to MHC class I molecule, TNF receptor proteins, Immunoglobulin-like proteins, cytokine receptors, integrins, signalling lymphocytic activation molecules (SLAM proteins), activating NK cell receptors, BTLA, a Toll ligand receptor, OX40, CD2, CD7, CD27, CD28, CD30, CD40, CD5, ICAM-1, LFA-1 (CD11a/CD18), 4-1BB (CD137), B7-H3, CD5, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. A costimulatory intracellular signaling domain refers to an intracellular portion of a costimulatory molecule. The intracellular signaling domain can comprise the entire intracellular portion, or the entire native intracellular signaling domain, of the molecule from which it is derived, or a functional fragment thereof.

The intracellular signaling domain can comprise the entire intracellular portion, or the entire native intracellular signaling domain, of the molecule from which it is derived, or a functional fragment thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO:7 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "effector function" refers to a specialized function of a cell. Effector function of a T cell, for example, may be cytolytic activity or helper activity including the secretion of cytokines. The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acid (RNA), or a combination of a DNA or RNA thereof, and polymers thereof in either single- or double-stranded form. The term "nucleic acid" includes a gene, cDNA or an mRNA. In one embodiment, the nucleic acid molecule is synthetic (e.g., chemically synthesized) or recombinant. Unless specifically limited, the term encompasses nucleic acids containing analogues or derivatives of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen" or "tumor antigen" interchangeably refers to a molecule (typically protein, carbohydrate or lipid) that is preferentially expressed on the surface of a cancer cell, either entirely or as a fragment (e.g., MHC/peptide), in comparison to a normal cell, and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a cancer-associated antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a cancer-associated antigen is a cell surface molecule that is inappropriately synthesized in the cancer cell, for instance, a molecule that contains deletions, additions or mutations in comparison to the molecule expressed on a normal cell. In some embodiments, a cancer-associated antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16): 4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)$_n$ (SEQ ID NO: 22), where n is a positive integer equal to or greater than 1. For example, n=1, n=2, n=3, n=4, n=5, n=6, n=7, n=8, n=9 and n=10. In one embodiment, the flexible polypeptide linkers include, but are not limited to, (Gly$_4$Ser)$_4$ (SEQ ID NO:27) or (Gly$_4$Ser)$_3$ (SEQ ID NO:28). In another embodiment, the linkers include multiple repeats of (Gly$_2$Ser), (GlySer) or (Gly$_3$Ser) (SEQ ID NO:29). Also included within the scope of the invention are linkers described in WO2012/138475, incorporated herein by reference).

As used herein, a 5' cap (also termed an RNA cap, an RNA 7-methylguanosine cap or an RNA m$^7$G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, e.g., mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In one embodiment of a construct for transient expression, the polyA is between 50 and 5000 (SEQ ID NO: 30), e.g., greater than 64, e.g., greater than 100, e.g., greater than 300 or 400 poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the cell. In embodiments, a CAR molecule is transiently expressed in a cell, e.g., host cell, for a finite period of time or number of cell replications, e.g., less than 50 days (e.g., less than 40, 30, 25, 20, 15, 10, 5, 4, 3, 2 or fewer days). In one embodiment, transient expression is effected using an in vitro transcribed RNA.

As used herein, "stable" refers to expression of a transgene that is for a longer period than transient expression. In embodiments, the transgene is integrated into the genome of a cell, e.g., a host cell, or contained within a stable plasmid replicon in the cell. In one embodiment, a transgene is integrated into the cell genome using a gene delivery vector, e.g., a retroviral vector such as a lentivirus vector.

Apheresis is the process in which whole blood is removed from an individual, separated into select components, and the remainder returned to circulation. Generally, there are two methods for the separation of blood components, centrifugal and non-centrifugal. Leukapheresis results in the active selection and removal of the patient's white blood cells.

As used herein, the terms "treat", "treatment" and "treating" refer to the reduction or amelioration of the progression, severity and/or duration of a proliferative disorder, or the amelioration of one or more symptoms (e.g., one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count. Treatment need not be 100%, and in some embodiments a reduction or delay in at least one symptom of the disease or disorder by at least 50%, 60%, 70%, 80%, 90%, 95%, or 99% is sufficient to be considered within these terms.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, e.g., humans). Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

In the context of the present invention, "tumor antigen" or "hyperproliferative disorder antigen" or "antigen associated with a hyperproliferative disorder" refers to antigens that are common to specific hyperproliferative disorders. In certain embodiments, the tumor antigen is derived from a cancer including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, or a ligand, which recognizes and binds with a cognate binding partner protein present in a sample, but which antibody or ligand does not substantially recognize or bind other molecules in the sample.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

Manufacturing and Methods of Making Immune Effector Cells

Provided herein are methods of manufacturing immune effector cells that can be engineered with a CAR, e.g., a CAR described herein, and reaction mixtures and compositions comprising such cells.

In one aspect, the disclosure features an immune effector cell (e.g., T cell, NK cell) engineered to express a CAR, wherein the engineered immune effector cell exhibits an antitumor property. An exemplary antigen is a cancer associated antigen (i.e., tumor antigen) described herein. In one aspect, a cell is transformed with the CAR and the CAR is expressed on the cell surface. In some embodiments, the cell (e.g., T cell, NK cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., T cell, NK cell) is transfected with a nucleic acid, e.g., mRNA, cDNA, DNA, encoding a CAR. In some such embodiments, the cell may transiently express the CAR.

Furthermore, the present invention provides CART compositions and their use in medicaments or methods for treating, among other diseases, cancer or any malignancy or autoimmune diseases involving cells or tissues which express a tumor antigen as described herein.

In one aspect, the CAR of the invention can be used to eradicate a normal cell that express a tumor antigen as described herein, thereby applicable for use as a cellular conditioning therapy prior to cell transplantation.

Sources of Immune Effector Cells

In embodiments, prior to expansion and genetic modification or other modification, a source of cells, e.g., immune effector cells, e.g., a population of immune effector cells cells, can be acquired, e.g., obtained, from a subject. In one embodiment, the immune effector cells comprise T cells. In one embodiment, the T cells comprise CD4 T cells. In another embodiment, the T cells comprise CD8 T cells. In another embodiment, the T cells comprise regulatory T cells. In a further embodiment, the T cells comprise naïve T-cells. In one embodiment, the immune effector cells comprise hemapoetic stem cells (e.g., cord blood cells). In another embodiment, the immune effector cells comprise B cells. In a further embodiment, the immune effector cells comprise NK cells. In another embodiment, the immune effector cells comprise NKT cells. In another embodiment, the immune effector cells comprise Th-17 cells. In one embodiment, the immune effector cells do not have T cell receptors. In another embodiment, the immune effector cells have non-functional or substantially impaired T cell receptors.

In some embodiments, a cell population, e.g., a harvested cell population, comprises a T cell or population of T cells, e.g., at various stages of differentiation. Stages of T cell differentiation include naïve T cells, stem central memory T cells, central memory T cells, effector memory T cells, and terminal effector T cells, from least to most differentiated. After antigen exposure, naïve T cells proliferate and differentiate into memory T cells, e.g., stem central memory T cells and central memory T cells, which then differentiate into effector memory T cells. Upon receiving appropriate T cell receptor, costimulatory, and inflammatory signals, memory T cells further differentiate into terminal effector T cells. See, e.g., Restifo. Blood. 124.4(2014):476-77; and Joshi et al. J. Immunol. 180.3(2008):1309-15.

Naïve T cells ($T_N$) are characterized by the following expression pattern of cell surface markers: CCR7+, CD62L+, CD45RO−, CD95−. Stem central memory T cells ($T_{SCM}$) are characterized by the following expression pattern of cell surface markers: CCR7+, CD62L+, CD45RO−, CD95+. Central memory T cells ($T_{CM}$) are characterized by the following expression pattern of cell surface markers: CCR7+, CD62L+, CD45RO+, CD95+. Effector memory T cells ($T_{EM}$) are characterized by the following expression pattern of cell surface markers: CCR7−, CD62L−, CD45RO+, CD95+. Terminal effector T cells ($T_{Eff}$) are characterized by the following expression pattern of cell surface markers: CCR7−, CD62L−, CD45RO−, CD95+. See, e.g., Gattinoni et al. Nat. Med. 17(2011):1290-7; and Flynn et al. Clin. Translat. Immunol. 3(2014):e20.

In embodiments, immune effector cells (e.g., a population of immune effector cells), e.g., T cells, are derived from (e.g., differentiated from) a stem cell, e.g., an embryonic stem cell or a pluripotent stem cell, e.g., an induced pluripotent stem cell (iPSC). In embodiments, the cells are autologous or allogeneic. In embodiments wherein the cells are allogeneic, the cells, e.g., derived from stem cells (e.g., iPSCs), are modified to reduce their alloreactivity. For example, the cells can be modified to reduce alloreactivity, e.g., by modifying (e.g., disrupting) their T cell receptor. In embodiments, a site specific nuclease can be used to disrupt the T cell receptor, e.g., after T-cell differentiation. In other examples, cells, e.g., T cells derived from iPSCs, can be generated from virus-specific T cells, which are less likely to cause graft-versus-host disease because of their recognition of a pathogen-derived antigen. In yet other examples, alloreactivity can be reduced, e.g., minimized, by generating iPSCs from common HLA haplotypes such that they are histocompatible with matched, unrelated recipient subjects. In yet other examples, alloreactivity can be reduced, e.g., minimized, by repressing HLA expression through genetic modification. For example, T cells derived from iPSCs can be processed as described in, e.g., Themeli et al. Nat. Biotechnol. 31.10(2013):928-35, incorporated herein by reference. In some examples, immune effector cells, e.g., T cells, derived from stem cells, can be processed/generated using methods described in WO2014/165707, incorporated herein by reference. Additional embodiments pertaining to allogeneic cells are described herein, e.g., in the "Allogeneic CAR Immune Effector Cells" section herein.

In certain aspects of the present disclosure, immune effector cells, e.g., T cells, can be obtained from a unit of blood collected from a subject using any number of techniques known to the skilled artisan, such as Ficoll™ separation. In one aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. In some embodiments, the population of T regulatory-depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, e.g. IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depleting reagent from Miltenyi™. In one embodiment, the ratio of cells to CD25 depletion reagent is $1e^7$ cells to 20 uL, or $1e^7$ cells to 15 uL, or $1e^7$ cells to 10 uL, or $1e^7$ cells to 5 uL, or 1e⁷ cells to 2.5 uL, or 1e⁷ cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory-depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product significantly reduces the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, mTOR inhibitor, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of a subject's relapse. In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. In an embodiment, methods of decreasing $T_{REG}$ cells include, but are not limited to, administration to the subject of one or more of cyclophosphamide, anti-GITR antibody, CD25-depletion, mTOR inhibitor, or a combination thereof. Administration of one or more of cyclophosphamide, anti-GITR antibody, CD25-depletion, or a combination thereof, can occur before, during or after an infusion of the CAR-expressing cell product.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product. In an embodiment, a subject is pre-treated with cyclophosphamide prior to collection of cells for CAR-expressing cell product manufacturing, thereby reducing the risk of subject relapse to CAR-expressing cell treatment (e.g., CTL019 treatment). In an embodiment, a subject is pre-treated with an anti-GITR antibody prior to collection of cells for CAR-expressing cell (e.g., T cell or NK cell) product manufacturing, thereby reducing the risk of subject relapse to CAR-expressing cell treatment.

In an embodiment, the CAR-expressing cell (e.g., T cell, NK cell) manufacturing process is modified to deplete $T_{REG}$ cells prior to manufacturing of the CAR-expressing cell (e.g., T cell, NK cell) product (e.g., a CTL019 product). In an embodiment, CD25-depletion is used to deplete TREG cells prior to manufacturing of the CAR-expressing cell (e.g., T cell, NK cell) product (e.g., a CTL019 product).

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory-depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory-depleted, e.g., CD25+ depleted cells, and check point inhibitor depleted cells, e.g., PD1+, LAG3+ and/or TIM3+ depleted cells. Exemplary check point inhibitors include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGF (e.g., TGFbeta), e.g., as described herein. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

Methods described herein can include a positive selection step. For example, T cells can isolated by incubation with anti-CD3/anti-CD28 (e.g., 3×28)-conjugated beads, such as DYNABEADS® M-450 CD3/CD28 T, for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another embodiment, the time period is 10 to 24 hours, e.g., 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 10 billion cells/ml, 9 billion/ml, 8 billion/ml, 7 billion/ml, 6 billion/ml, or 5 billion/ml is used. In one aspect, a concentration of 1 billion cells/ml is used. In yet one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5 \times 10^6$/ml. In other aspects, the concentration used can be from about $1 \times 10^5$/ml to $1 \times 10^6$/ml, and any integer value in between.

In other aspects, the cells may be incubated on a rotator for varying lengths of time at varying speeds at either 2-10° C. or at room temperature.

In one embodiment, a plurality of the immune effector cells of the population do not express diaglycerol kinase (DGK), e.g., is DGK-deficient. In one embodiment, a plurality of the immune effector cells of the population do not express Ikaros, e.g., is Ikaros-deficient. In one embodiment, a plurality of the immune effector cells of the population do not express DGK and Ikaros, e.g., is both DGK and Ikaros-deficient.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAM-PATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" Clinical & Translational Immunology (2015) 4, e31; doi:10.1038/cti.2014.31.

In one embodiment, the methods disclosed herein can utilize culture media conditions comprising serum-free medium. In one embodiment, the serum free medium is OpTmizer CTS (LifeTech), Immunocult XF (Stemcell technologies), CellGro (CellGenix), TexMacs (Miltenyi), Stemline (Sigma), Xvivo15 (Lonza), PrimeXV (Irvine Scientific), or StemXVivo (RandD systems). The serum-free medium can be supplemented with a serum substitute such as ICSR (immune cell serum replacement) from LifeTech. The level of serum substitute (e.g., ICSR) can be, e.g., up to 5%, e.g., about 1,%, 2%, 3%, 4%, or 5%. In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

In embodiments, the methods, e.g., manufacturing methods, further comprise contacting with IL-15 and/or IL-7, a cell population (e.g., a cell population in which T regulatory cells, such as CD25+ T cells, have been depleted; or a cell population that has previously contacted an anti-CD25 antibody, fragment thereof, or CD25-binding ligand). For example, the cell population (e.g., that has previously contacted an anti-CD25 antibody, fragment thereof, or CD25-binding ligand) is expanded in the presence of IL-15 and/or IL-7.

In some embodiments a CAR-expressing cell described herein is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising an IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Rα polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the CAR-expressing cell described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

Allogeneic CAR

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta), or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some embodiments, downregulation of HLA may be accomplished by reducing or eliminating expression of beta-2 microglobulin (B2M), In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not express or expresses at low levels an inhibitory molecule, e.g. by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF (e.g., TGFbeta). Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR and/or HLA, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

Expression systems for siRNA and shRNAs, and exemplary shRNAs, are described, e.g., in paragraphs 649 and 650 of International Application WO2015/142675, filed Mar. 13, 2015, which is incorporated by reference in its entirety.

CRISPR to Inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

The CRISPR/Cas system, and uses thereof, are described, e.g., in paragraphs 651-658 of International Application WO2015/142675, filed Mar. 13, 2015, which is incorporated by reference in its entirety.

TALEN to Inhibit TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

TALENs, and uses thereof, are described, e.g., in paragraphs 659-665 of International Application WO2015/142675, filed Mar. 13, 2015, which is incorporated by reference in its entirety.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

ZFNs, and uses thereof, are described, e.g., in paragraphs 666-671 of International Application WO2015/142675, filed Mar. 13, 2015, which is incorporated by reference in its entirety.

Telomerase Expression

Telomeres play a crucial role in somatic cell persistence, and their length is maintained by telomerase (TERT). Telomere length in CLL cells may be very short (Roth et al., "Significantly shorter telomeres in T-cells of patients with ZAP-70+/CD38 chronic lymphocytic leukaemia" British Journal of Haematology, 143, 383-386., Aug. 28 2008), and may be even shorter in manufactured CAR-expressing cells, e.g., CART19 cells, limiting their potential to expand after adoptive transfer to a patient. Telomerase expression can rescue CAR-expressing cells from replicative exhaustion.

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

Telomerase expression may be stable (e.g., the nucleic acid may integrate into the cell's genome) or transient (e.g., the nucleic acid does not integrate, and expression declines after a period of time, e.g., several days). Stable expression may be accomplished by transfecting or transducing the cell with DNA encoding the telomerase subunit and a selectable marker, and selecting for stable integrants. Alternatively or in combination, stable expression may be accomplished by site-specific recombination, e.g., using the Cre/Lox or FLP/FRT system.

Transient expression may involve transfection or transduction with a nucleic acid, e.g., DNA or RNA such as mRNA. In some embodiments, transient mRNA transfection avoids the genetic instability sometimes associated with stable transfection with TERT. Transient expression of exogenous telomerase activity is described, e.g., in International Application WO2014/130909, which is incorporated by reference herein in its entirety. In embodiments, mRNA-based transfection of a telomerase subunit is performed according to the messenger RNA Therapeutics™ platform commercialized by Moderna Therapeutics. For instance, the method may be a method described in U.S. Pat. Nos. 8,710,200, 8,822,663, 8,680,069, 8,754,062, 8,664,194, or 8,680,069.

In an embodiment, hTERT has the amino acid sequence of GenBank Protein ID AAC51724.1 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795), provided herein as SEQ ID NO: 5.

In an embodiment, the hTERT has a sequence at least 80%, 85%, 90%, 95%, 96^, 97%, 98%, or 99% identical to the sequence of SEQ ID NO: 5. In an embodiment, the hTERT has a sequence of SEQ ID NO: 5. In an embodiment, the hTERT comprises a deletion (e.g., of no more than 5, 10, 15, 20, or 30 amino acids) at the N-terminus, the C-terminus, or both. In an embodiment, the hTERT comprises a transgenic amino acid sequence (e.g., of no more than 5, 10, 15, 20, or 30 amino acids) at the N-terminus, the C-terminus, or both.

In an embodiment, the hTERT is encoded by the nucleic acid sequence of GenBank Accession No. AF018167 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795), provided herein as SEQ ID NO: 8.

In an embodiment, the hTERT is encoded by a nucleic acid having a sequence at least 80%, 85%, 90%, 95%, 96%, 97%, 98%, or 99% identical to the sequence of SEQ ID NO: 8. In an embodiment, the hTERT is encoded by a nucleic acid of SEQ ID NO: 8.

RNA Transfection

Disclosed herein are methods for producing an in vitro transcribed RNA CAR. The methods described herein can include introducing a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (e.g., SEQ ID NO:30). RNA so produced can efficiently transfect different kinds of cells. In one aspect, the template includes sequences for the CAR. RNA CAR and methods of using the same are described, e.g., in paragraphs 553-570 of in International Application WO2015/142675, filed Mar. 13, 2015, which is herein incorporated by reference in its entirety.

An immune effector cell can include a CAR encoded by a messenger RNA (mRNA). In one aspect, the mRNA encoding a CAR described herein is introduced into an immune effector cell, e.g., made by a method described herein, for production of a CAR-expressing cell.

In one embodiment, the in vitro transcribed RNA CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired temple for in vitro transcription is a CAR described herein. For example, the template for the RNA CAR comprises an extracellular region comprising a single chain variable domain of an antibody to a tumor associated antigen described herein; a hinge region (e.g., a hinge region described herein), a transmembrane domain (e.g., a transmembrane domain described herein such as a transmembrane domain of CD8a); and a cytoplasmic region that includes an intracellular signaling domain, e.g., an intracellular signaling domain described herein, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs.

The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. In embodiments, the RNA has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In one embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 31) (size can be 50-5000 T (SEQ ID NO: 32)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (e.g., SEQ ID NO: 33).

Poly(A) tails of RNAs can be further extended following in vitro transcription with the use of a poly(A) polymerase, such as *E. coli* polyA polymerase (E-PAP). In one embodiment, increasing the length of a poly(A) tail from 100 nucleotides to between 300 and 400 nucleotides (SEQ ID NO: 34) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In one embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Activation and/or Expansion of Immune Effector Cells

In embodiments, the disclosure provides for methods of expanding a population of immune effector cells by contacting the population of immune effector cells with a nucleic acid encoding a CAR, under conditions suitable for expression, e.g., transient expression, of the CAR, wherein the CAR targets a cognate antigen molecule; and culturing the population of immune effector cells in the presence of a ligand, e.g., the cognate antigen molecule. In one embodiment, the nucleic acid is RNA, e.g., in vitro transcribed RNA. In another embodiment, the cognate antigen molecule is a cancer associated antigen molecule.

Methods presented herein provide for expanding a population of immune effector cells by contact with a surface having attached thereto a cognate antigen molecule that stimulates a CAR on the surface of the immune effector cells. In certain aspects, the cognate antigen molecule may be in solution or coupled to a surface. In one aspect, the cognate antigen molecule providing the stimulatory signal is bound to a cell surface. In certain aspects, the cognate antigen molecule can be in solution. In one aspect, cognate antigen molecule may be in soluble form, and then cross-linked to a surface.

In one embodiment, the cognate antigen molecule is attached to a substrate. In one embodiment, the substrate is a solid support. In one embodiment, the substrate is selected from microtiter plates (e.g., ELISA plates); membranes (e.g., nitrocellulose membranes, PVDF membranes, nylon membranes, acetate derivatives, and combinations thereof); fiber matrix, Sepharose matrix, sugar matrix; plastic chips; glass chips; or any type of bead (e.g., Luminex beads, Dynabeads, magnetic beads, flow-cytometry beads, and combinations thereof). In one embodiment, the substrate is an ELISA plate. In another embodiment, the substrate is a bead, e.g., Dynabeads.

Ratios of particles to cells from 1:500 to 500:1 and any integer values in between may be used to stimulate immune effector cells, e.g., T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of cognate antigen molecule-coupled particles to immune effector cells, e.g., T cells, that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one suitable ratio being at least 1:1 particles per T cell. In one aspect, a ratio of particles to cells of 1:1 or less is used. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. In one particular aspect, a suitable particle: cell ratio is 1:3.

In further aspects, the cells, such as T cells, are combined with cognate antigen molecule-coated beads, the beads and the cells are subsequently separated, and then the cells are cultured. In an alternative aspect, prior to culture, the cognate antigen molecule-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which cognate antigen molecules are attached (3×28 beads) to contact the T cells. In one aspect the cells (for example, $10^4$ to $10^9$ T cells) and beads (for example, DYNABEADS® M-450 Tosylactivated paramagnetic beads at a ratio of 1:3) are combined in a buffer, for example PBS (without divalent cations such as, calcium and magnesium). Other cell concentrations are contemplated. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express the expressed, e.g., transiently expressed, CAR.

In one embodiment, cells transduced with a nucleic acid encoding a CAR, e.g., a CAR described herein, e.g., a CD19 CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 40 days (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 days). In one embodiment, the cells are expanded for a period of 4 to 9 days. In one embodiment, the cells are expanded for a period of 8 days or less, e.g., 7, 6 or 5 days. In one embodiment, the cells are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CD19 CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CD19 CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CD19 CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

Several cycles of stimulation may also be desired such that culture time of immune effector cells, e.g., T cells, can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence IL-15 and/or IL-7 (e.g., IL-15 and IL-7). In one embodiment, the cells are expanded in the presence of IL-2.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Various assays can be used to evaluate the efficacy of the methods described herein, such as but not limited to, transduction efficiency, the ability to express the CAR, the ability to expand immune effector cells following antigen stimulation, and to sustain immune effector cell expansion. Assays to evaluate the methods of the present invention are described in further detail below.

Transduction efficiency can be measured by flow cytometry. For example, as described herein, surface expression of CAR on immune effector cells expressing a CAR (e.g., a CD19 CAR) can be measured. Surface expression of CAR is examined by incubating cells with biotin-labeled polyclonal goat anti-mouse F(ab)2 antibodies (Jackson Immunoresearch, West Grove, Pa.) at 4° C. for 30 minutes, followed by two washes with FACs buffer (PBS plus 3% BSA) and coupling with phycoerythrin-labeled streptavidin (BD Pharmingen, San Diego, Calif.). Sample data can be collected on the LSRII Fortessa (BD Biosciences) and analyzed with FlowJo software (Treestar). Transduction efficiency can also be measured by any other art know method for measuring RNA levels (e.g., northern analysis, quantitative real time PCR) or protein levels (e.g., western analysis).

Expansion of immune effector cells following antigen stimulation can also be measured by flow cytometry. For example, expansion of immune effector cells expressing a CAR (e.g., a CD19 CAR) stimulated with a cognate antigen molecule (e.g., anti-idiotype CD19) can be measured as described herein. Live cells were gated on Live/Dead Aqua-negative and then gated for CD4 (or CD8)-positive. Absolute T cell counts can be determined by using CountBright Absolute Counting Beads (Life Technologies) using the formula: (Number of T cells events/number of bead events) X number of beads used.

Sustained CAR+ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter following stimulation with αCD3/αCD28 coated magnetic beads on day 0, and transduction with the indicated CAR on day 1.

Other assays, including those described in the Example section herein, as well as those that are known in the art can also be used to evaluate the CARs described herein.

Chimeric Antigen Receptor (CAR)

The present invention provides immune effector cells that are engineered to contain one or more CARs that direct the immune effector cells to cancer. This is achieved through an antigen binding domain on the CAR that is specific for a cancer associated antigen. There are two classes of cancer associated antigens (tumor antigens) that can be targeted by the CARs described herein: (1) cancer associated antigens that are expressed on the surface of cancer cells; and (2) cancer associated antigens that itself is intracellar, however, a fragment of such antigen (peptide) is presented on the surface of the cancer cells by MHC (major histocompatibility complex).

Accordingly, an immune effector cell, e.g., obtained by a method described herein, can be engineered to contain a CAR that target one of the following cancer associated antigens (tumor antigens): CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bD-Galp(1-4)bDGlcp(1-1)Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4)bDGlcp(1-1)Cer); transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

Bispecific CARs

In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope.

In certain embodiments, the antibody molecule is a multi-specific (e.g., a bispecific or a trispecific) antibody molecule. Protocols for generating bispecific or heterodimeric antibody molecules, and various configurations for bispecific antibody molecules, are described in, e.g., paragraphs 455-458 of WO2015/142675, filed Mar. 13, 2015, which is incorporated by reference in its entirety.

In one aspect, the bispecific antibody molecule is characterized by a first immunoglobulin variable domain sequence, e.g., a scFv, which has binding specificity for CD19, e.g., comprises a scFv as described herein, or comprises the light chain CDRs and/or heavy chain CDRs from a scFv described herein, and a second immunoglobulin variable domain sequence that has binding specificity for a second epitope on a different antigen.

Chimeric TCR

In one aspect, the antibodies and antibody fragments of the present invention (e.g., CD19 antibodies and fragments) can be grafted to one or more constant domain of a T cell receptor ("TCR") chain, for example, a TCR alpha or TCR beta chain, to create a chimeric TCR. Without being bound by theory, it is believed that chimeric TCRs will signal through the TCR complex upon antigen binding. For example, an scFv as disclosed herein, can be grafted to the constant domain, e.g., at least a portion of the extracellular constant domain, the transmembrane domain and the cytoplasmic domain, of a TCR chain, for example, the TCR alpha chain and/or the TCR beta chain. As another example, an antibody fragment, for example a VL domain as described herein, can be grafted to the constant domain of a TCR alpha chain, and an antibody fragment, for example a VH domain as described herein, can be grafted to the constant domain of a TCR beta chain (or alternatively, a VL domain may be grafted to the constant domain of the TCR beta chain and a VH domain may be grafted to a TCR alpha chain). As another example, the CDRs of an antibody or antibody fragment may be grafted into a TCR alpha and/or beta chain to create a chimeric TCR. For example, the LCDRs disclosed herein may be grafted into the variable domain of a TCR alpha chain and the HCDRs disclosed herein may be grafted to the variable domain of a TCR beta chain, or vice versa. Such chimeric TCRs may be produced, e.g., by methods known in the art (For example, Willemsen R A et al, Gene Therapy 2000; 7: 1369-1377; Zhang T et al, Cancer Gene Ther 2004; 11: 487-496; Aggen et al, Gene Ther. 2012 April; 19(4):365-74).

Non-Antibody Scaffolds

In embodiments, the antigen binding domain comprises a non-antibody scaffold, e.g., a fibronectin, ankyrin, domain antibody, lipocalin, small modular immuno-pharmaceutical, maxybody, Protein A, or affilin. The non-antibody scaffold has the ability to bind to target antigen on a cell. In embodiments, the antigen binding domain is a polypeptide or fragment thereof of a naturally occurring protein expressed on a cell. In some embodiments, the antigen binding domain comprises a non-antibody scaffold. A wide variety of non-antibody scaffolds can be employed so long as the resulting polypeptide includes at least one binding region which specifically binds to the target antigen on a target cell.

Non-antibody scaffolds include: fibronectin (Novartis, MA), ankyrin (Molecular Partners AG, Zurich, Switzerland), domain antibodies (Domantis, Ltd., Cambridge, Mass., and Ablynx nv, Zwijnaarde, Belgium), lipocalin (Pieris Proteolab AG, Freising, Germany), small modular immuno-pharmaceuticals (Trubion Pharmaceuticals Inc., Seattle, Wash.), maxybodies (Avidia, Inc., Mountain View, Calif.), Protein A (Affibody AG, Sweden), and affilin (gamma-crystallin or ubiquitin) (Scil Proteins GmbH, Halle, Germany).

In an embodiment the antigen binding domain comprises the extracellular domain, or a counter-ligand binding fragment thereof, of molecule that binds a counterligand on the surface of a target cell. The immune effector cells can comprise a recombinant DNA construct comprising sequences encoding a CAR, wherein the CAR comprises an antigen binding domain (e.g., antibody or antibody fragment, TCR or TCR fragment) that binds specifically to a tumor antigen, e.g., an tumor antigen described herein, and an intracellular signaling domain. The intracellular signaling domain can comprise a costimulatory signaling domain and/or a primary signaling domain, e.g., a zeta chain. As described elsewhere, the methods described herein can include transducing a cell, e.g., from the population of T regulatory-depleted cells, with a nucleic acid encoding a CAR, e.g., a CAR described herein.

In specific aspects, a CAR comprises a scFv domain, wherein the scFv may be preceded by an optional leader sequence such as provided in SEQ ID NO: 1, and followed by an optional hinge sequence such as provided in SEQ ID NO:2 or SEQ ID NO:36 or SEQ ID NO:23, a transmembrane region such as provided in SEQ ID NO:6, an intracellular signalling domain that includes SEQ ID NO:7 or SEQ ID NO:16 and a CD3 zeta sequence that includes SEQ ID NO:9 or SEQ ID NO:10, e.g., wherein the domains are contiguous with and in the same reading frame to form a single fusion protein.

In one aspect, an exemplary CAR constructs comprise an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), and an intracellular stimulatory domain (e.g., an intracellular stimulatory domain described herein). In one aspect, an exemplary CAR construct comprises an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), an intracellular costimulatory signaling domain (e.g., a costimulatory signaling domain described herein) and/or an intracellular primary signaling domain (e.g., a primary signaling domain described herein).

An exemplary leader sequence is provided as SEQ ID NO: 1. An exemplary hinge/spacer sequence is provided as SEQ ID NO: 2 or SEQ ID NO:36 or SEQ ID NO:23. An exemplary transmembrane domain sequence is provided as SEQ ID NO:6. An exemplary sequence of the intracellular signaling domain of the 4-1BB protein is provided as SEQ ID NO: 7. An exemplary sequence of the intracellular signaling domain of CD27 is provided as SEQ ID NO:16. An exemplary CD3zeta domain sequence is provided as SEQ ID NO: 9 or SEQ ID NO:10.

In one aspect, the immune effector cell comprises a recombinant nucleic acid construct comprising a nucleic acid molecule encoding a CAR, wherein the nucleic acid molecule comprises a nucleic acid sequence encoding an antigen binding domain, wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, CD27, 4-1BB, and the like. In some instances, the CAR can comprise any combination of CD3-zeta, CD28, 4-1BB, and the like.

The nucleic acid sequences coding for the desired molecules can be obtained using recombinant methods known in the art, such as, for example by screening libraries from cells expressing the nucleic acid molecule, by deriving the nucleic acid molecule from a vector known to include the same, or by isolating directly from cells and tissues containing the same, using standard techniques. Alternatively, the nucleic acid of interest can be produced synthetically, rather than cloned.

Nucleic acids encoding a CAR can be introduced into the immune effector cells using, e.g., a retroviral or lentiviral vector construct.

Nucleic acids encoding a CAR can also be introduced into the immune effector cell using, e.g., an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a polyA tail, typically 50-2000 bases in length (e.g., described herein, e.g., SEQ ID NO:35). RNA so produced can efficiently transfect different kinds of cells. In one embodiment, the template includes sequences for the CAR. In an embodiment, an RNA CAR vector is transduced into a cell, e.g., a T cell by electroporation.

Antigen Binding Domain

In one aspect, a plurality of the immune effector cells, e.g., the population of T regulatory-depleted cells, include a nucleic acid encoding a CAR that comprises a target-specific binding element otherwise referred to as an antigen binding domain. The choice of binding element depends upon the type and number of ligands that define the surface of a target cell. For example, the antigen binding domain may be chosen to recognize a ligand that acts as a cell surface marker on target cells associated with a particular disease state. Thus, examples of cell surface markers that may act as ligands for the antigen binding domain in a CAR described herein include those associated with viral, bacterial and parasitic infections, autoimmune disease and cancer cells.

In one aspect, the portion of the CAR comprising the antigen binding domain comprises an antigen binding domain that targets a tumor antigen, e.g., a tumor antigen described herein.

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, a T cell receptor (TCR), or a fragment there of, e.g., single chain TCR, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

In an embodiment, the antigen binding domain comprises an anti-CD19 antibody, or fragment thereof, e.g., an scFv. For example, the antigen binding domain comprises a variable heavy chain and a variable light chain listed in Table 1. The linker sequence joining the variable heavy and variable light chains can be, e.g., any of the linker sequences described herein, or alternatively, can be GSTSGSGKPGS-GEGSTKG (SEQ ID NO:104).

TABLE 1

Anti-CD19 antibody binding domains

| | | | SEQ ID NO: |
|---|---|---|---|
| CD19 | huscFv1 | EIVMTQSPATLSLSPGERATLSCRASQDISKYLNWYQQKPGQA PRLLIYHTSRLHSGIPARFSGSGSGTDYTLTISSLQPEDFAVY FCQQGNTLPYTFGQGTKLEIKGGGGSGGGGSGGGGSQVQLQES GPGLVKPSETLSLTCTVSGVSLPDYGVSWIRQPPGKGLEWIGV IWGSETTYYSSLKSRVTISKDNSKNQVSLKLSSVTAADTAVY YCAKHYYYGGSYAMDYWGQGTLVTVSS | 107 |
| CD19 | huscFv2 | Eivmtqspatlslspgeratlscrasqdiskylnwyqqkpgqaprll iyhtsrlhsgiparfsgsgsgtdytltisslqpedfavyfcqqgntl pytfgqgtkleikggggsggggsggggsqvqlqesgpglvkpsetls ltctvsgvslpdygvswirqppgkglewigviwgsettyyqsslksr vtiskdnsknqvslklssvtaadtavyycakhyyyggsyamdywgqg tlvtvss | 108 |

TABLE 1-continued

Anti-CD19 antibody binding domains

| CD19 | huscFv3 | Qvqlqesgpglvkpsetlsltctvsgvslpdygvswirqppgkglew igviwgsettyyssslksrvtiskdnsknqvslklssvtaadtavyy cakhyyygssyamdywgqgtlvtssggggsggggsggggseivmtq spatlslspgeratlscrasqdiskylnwyqqkpgqaprlliyhtsr lhsgiparfsgsgsgtdytltisslqpedfavyfcqqgntlpytfgq gtkleik | 109 |
|---|---|---|---|
| CD19 | huscFv4 | Qvqlqesgpglvkpsetlsltctvsgvslpdygvswirqppgkglew igviwgsettyyqsslksrvtiskdnsknqvslklssvtaadtavyy cakhyyygssyamdywgqgtlvtssggggsggggsggggseivmtq spatlslspgeratlscrasqdiskylnwyqqkpgqaprlliyhtsr lhsgiparfsgsgsgtdytltisslqpedfavyfcqqgntlpytfgq gtkleik | 110 |
| CD19 | huscFv5 | Eivmtqspatlslspgeratlscrasqdiskylnwyqqkpgqaprll iyhtsrlhsgiparfsgsgsgtdytltisslqpedfavyfcqqgntl pytfgqgtkleikggggsggggsggggsggggsqvqlqesgpglvkp setlsltctvsgvslpdygvswirqppgkglewigviwgsettyyss slksrvtiskdnsknqvslklssvtaadtavyycakhyyygssyamd ywgqgtlvtvss | 111 |
| CD19 | huscFv6 | Eivmtqspatlslspgeratlscrasqdiskylnwyqqkpgqaprll iyhtsrlhsgiparfsgsgsgtdytltisslqpedfavyfcqqgntl pytfgqgtkleikggggsggggsggggsggggsqvqlqesgpglvkp setlsltctvsgvslpdygvswirqppgkglewigviwgsettyyqs slksrvtiskdnsknqvslklssvtaadtavyycakhyyygssyamd ywgqgtlvtvss | 112 |
| CD19 | huscFv7 | Qvqlqesgpglvkpsetlsltctvsgvslpdygvswirqppgkglew igviwgsettyyssslksrvtiskdnsknqvslklssvtaadtavyy cakhyyygssyamdywgqgtlvtssggggsggggsggggsggggse ivmtqspatlslspgeratlscrasqdiskylnwyqqkpgqaprlli yhtsrlhsgiparfsgsgsgtdytltisslqpedfavyfcqqgntlp ytfgqgtkleik | 113 |
| CD19 | huscFv8 | Qvqlqesgpglvkpsetlsltctvsgvslpdygvswirqppgkglew igviwgsettyyqsslksrvtiskdnsknqvslklssvtaadtavyy cakhyyygssyamdywgqgtlvtssggggsggggsggggsggggse ivmtqspatlslspgeratlscrasqdiskylnwyqqkpgqaprlli yhtsrlhsgiparfsgsgsgtdytltisslqpedfavyfcqqgntlp ytfgqgtkleik | 114 |
| CD19 | huscFv9 | Eivmtqspatlslspgeratlscrasqdiskylnwyqqkpgqaprll iyhtsrlhsgiparfsgsgsgtdytltisslqpedfavyfcqqgntl pytfgqgtkleikggggsggggsggggsggggsqvqlqesgpglvkp setlsltctvsgvslpdygvswirqppgkglewigviwgsettyyns slksrvtiskdnsknqvslklssvtaadtavyycakhyyygssyamd ywgqgtlvtvss | 115 |
| CD19 | HuscFv10 | Qvqlqesgpglvkpsetlsltctvsgvslpdygvswirqppgkglew igviwgsettyynsslksrvtiskdnsknqvslklssvtaadtavyy cakhyyygssyamdywgqgtlvtssggggsggggsggggsggggse ivmtqspatlslspgeratlscrasqdiskylnwyqqkpgqaprlli yhtsrlhsgiparfsgsgsgtdytltisslqpedfavyfcqqgntlp ytfgqgtkleik | 116 |
| CD19 | HuscFv11 | Eivmtqspatlslspgeratlscrasqdiskylnwyqqkpgqaprll iyhtsrlhsgiparfsgsgsgtdytltisslqpedfavyfcqqgntl pytfgqgtkleikggggsggggsggggsqvqlqesgpglvkpsetls ltctvsgvslpdygvswirqppgkglewigviwgsettyynsslksr vtiskdnsknqvslklssvtaadtavyycakhyyygssyamdywgqg tlvtvss | 117 |
| CD19 | HuscFv12 | Qvqlqesgpglvkpsetlsltctvsgvslpdygvswirqppgkglew igviwgsettyynsslksrvtiskdnsknqvslklssvtaadtavyy cakhyyygssyamdywgqgtlvtssggggsggggsggggseivmtq spatlslspgeratlscrasqdiskylnwyqqkpgqaprlliyhtsr lhsgiparfsgsgsgtdytltisslqpedfavyfcqqgntlpytfgq gtkleik | 118 |
| CD19 | muCTL019 scFv | Diqmtqttsslsaslgdrvtiscrasqdiskylnwyqqkpdgtvkll iyhtsrlhsgvpsrfsgsgsgtdysltisnleqediatyfcqqgntl pytfgggtkleitggggsggggsggggsevklqesgpglvapsqsls vtctvsgvslpdygvswirqpprkglewlgviwgsettyynsalksr ltiikdnsksqvflkmnslqtddtaiyycakhyyygssyamdywgqg tsvtvss | 119 |

TABLE 1-continued

Anti-CD19 antibody binding domains

| Antibody | VH Sequence | VL Sequence |
|---|---|---|
| SSJ25-C1 | QVQLLESGAELVRPGSSVKISCKASGYAFSS YWMNWVKQRPGQGLEWIGQIYPGDGDTNYNG KFKGQATLTADKSSSTAYMQLSGLTSEDSAV YSCARKTISSVVDFYFDYWGQGTTVT | ELVLTQSPKFMSTSVGDRVSVTCKASQNVGT NVAWYQQKPGQSPKPLIYSATYRNSGVPDRF TGSGSGTDFTLTITNVQSKDLADYFYFCQYN RYPYTSGGGTKLEIKRRS |
| SEQ ID NO: | 120 | 121 |

CD19 CAR constructs containing humanized anti-CD19 scFv domains are described in PCT publication WO 2014/153270, incorporated herein by reference.

The sequences of murine and humanized CDR sequences of the anti-CD19 scFv domains are shown in Table 2 for the heavy chain variable domains and in Table 3 for the light chain variable domains. "ID" stands for the respective SEQ ID NO for each CDR.

TABLE 2

Heavy Chain Variable Domain CDRs (Kabat) of CD19 Antibodies

| Candidate | FW | HCDR1 | ID | HCDR2 | ID | HCDR3 | ID |
|---|---|---|---|---|---|---|---|
| murine_CART19 | | DYGVS | 122 | VIWGSETTYYNSALKS | 123 | HYYYGGSYAMDY | 127 |
| humanized_CART19 a | VH4 | DYGVS | 122 | VIWGSETTYYSSSLKS | 124 | HYYYGGSYAMDY | 127 |
| humanized_CART19 b | VH4 | DYGVS | 122 | VIWGSETTYYQSSLKS | 125 | HYYYGGSYAMDY | 127 |
| humanized_CART19 c | VH4 | DYGVS | 122 | VIWGSETTYYNSSLKS | 126 | HYYYGGSYAMDY | 127 |

TABLE 3

Light Chain Variable Domain CDRs (Kabat) of CD19 Antibodies

| Candidate | FW | LCDR1 | ID | LCDR2 | ID | LCDR3 | ID |
|---|---|---|---|---|---|---|---|
| murine_CART19 | | RASQDISKYLN | 128 | HTSRLHS | 129 | QQGNTLPYT | 130 |
| humanized_CART19 a | VK3 | RASQDISKYLN | 128 | HTSRLHS | 129 | QQGNTLPYT | 130 |
| humanized_CART19 b | VK3 | RASQDISKYLN | 128 | HTSRLHS | 129 | QQGNTLPYT | 130 |
| humanized_CART19 c | VK3 | RASQDISKYLN | 128 | HTSRLHS | 129 | QQGNTLPYT | 130 |

Any known CD19 CAR, e.g., the CD19 antigen binding domain of any known CD19 CAR, in the art can be used in accordance with the present disclosure. For example, LG-740; CD19 CAR described in the U.S. Pat. Nos. 8,399,645; 7,446,190; Xu et al., Leuk Lymphoma. 2013 54(2): 255-260(2012); Cruz et al., Blood 122(17):2965-2973 (2013); Brentjens et al., Blood, 118(18):4817-4828 (2011); Kochenderfer et al., Blood 116(20):4099-102 (2010); Kochenderfer et al., Blood 122 (25):4129-39(2013); and 16th Annu Meet Am Soc Gen Cell Ther (ASGCT) (May 15-18, Salt Lake City) 2013, Abst 10.

Exemplary target antigens that can be targeted using the CAR-expressing cells, include, but are not limited to, CD19, CD123, EGFRvIII, CD33, mesothelin, BCMA, and GFR ALPHA-4, among others, as described in, for example, WO2014/153270, WO 2014/130635, WO2016/028896, WO 2014/130657, WO2016/014576, WO 2015/090230, WO2016/014565, WO2016/014535, and WO2016/025880, each of which is herein incorporated by reference in its entirety.

In one embodiment, the CAR T cell that specifically binds to CD19 has the USAN designation TISAGENLECLEUCEL-T. CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In other embodiments, the CAR-expressing cells can specifically bind to humanized CD19, e.g., can include a CAR molecule, or an antigen binding domain (e.g., a humanized antigen binding domain) according to Table 3 of WO2014/153270, incorporated herein by reference. The amino acid and nucleotide sequences encoding the CD19 CAR molecules and antigen binding domains (e.g., including one, two, three VH CDRs; and one, two, three VL CDRs according to Kabat or Chothia), as specified in WO2014/153270, are provided in Table 1 and in the Sequence Listing submitted herewith. Amino and nucleotide sequences identical and substantially identical to the aforesaid sequences provided in the Sequence Listing are specifically incorporated into the instant specification.

In other embodiments, the CAR-expressing cells can specifically bind to CD123, e.g., can include a CAR molecule (e.g., any of the CAR1 to CAR8), or an antigen binding domain according to Tables 1-2 of WO 2014/130635, incorporated herein by reference. The amino acid and nucleotide sequences encoding the CD123 CAR molecules and antigen binding domains (e.g., including one, two, three VH CDRs; and one, two, three VL CDRs according to Kabat or Chothia), as specified in WO 2014/130635, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 142-193, or a sequence substantially identical thereto.

In some embodiments, the CAR molecule or antigen binding domain comprises one or more (e.g., 2, 3, 4, 5, or all) of the heavy and/or light CDR sequences in SEQ ID NO: 147 (e.g., amino acid residues 45-59, 75-81, 114-122, 183-187, 202-218, and/or 251-259 of SEQ ID NO: 147). In some embodiments, the CAR molecule or antigen binding domain comprises one or more (e.g., 2, 3, 4, 5, or all) of the heavy and/or light CDR sequences in SEQ ID NO: 153 (e.g., amino acid residues 45-59, 75-81, 114-122, 183-187, 202-218, and/or 251-259 of SEQ ID NO: 153). In some embodiments, the CAR molecule or antigen binding domain comprises one or more (e.g., 2, 3, 4, 5, or all) of the heavy and/or light CDR sequences in SEQ ID NO: 159 (e.g., amino acid residues 45-59, 75-81, 114-122, 183-187, 202-218, and/or 251-259 of SEQ ID NO: 159). In some embodiments, the CAR molecule or antigen binding domain comprises one or more (e.g., 2, 3, 4, 5, or all) of the heavy and/or light CDR sequences in SEQ ID NO: 165 (e.g., amino acid residues 45-59, 75-81, 114-122, 183-187, 202-218, and/or 251-259 of SEQ ID NO: 165). In some embodiments, the CAR molecule or antigen binding domain comprises one or more (e.g., 2, 3, 4, 5, or all) of the heavy and/or light CDR sequences in SEQ ID NO: 171 (e.g., amino acid residues 52-56, 71-87, 120-128, 183-197, 213-219, and/or 252-260 of SEQ ID NO: 171). In some embodiments, the CAR molecule or antigen binding domain comprises one or more (e.g., 2, 3, 4, 5, or all) of the heavy and/or light CDR sequences in SEQ ID NO: 177 (e.g., amino acid residues 52-56, 71-87, 120-128, 183-197, 213-219, and/or 252-260 of SEQ ID NO: 177). In some embodiments, the CAR molecule or antigen binding domain comprises one or more (e.g., 2, 3, 4, 5, or all) of the heavy and/or light CDR sequences in SEQ ID NO: 183 (e.g., amino acid residues 52-56, 71-87, 120-128, 183-197, 213-219, and/or 252-260 of SEQ ID NO: 183). In some embodiments, the CAR molecule or antigen binding domain comprises one or more (e.g., 2, 3, 4, 5, or all) of the heavy and/or light CDR sequences in SEQ ID NO: 189 (e.g., amino acid residues 52-56, 71-87, 120-128, 183-197, 213-219, and/or 252-260 of SEQ ID NO: 189). In some embodiments, the CAR molecule or antigen binding domain comprises one or more (e.g., 2, 3, 4, 5, or all) of the heavy and/or light CDR sequences in SEQ ID NO: 191 (e.g., amino acid residues 47-61, 77-83, 116-124, 180-184, 199-215, and/or 248-256 of SEQ ID NO: 191). In some embodiments, the CAR molecule or antigen binding domain comprises one or more (e.g., 2, 3, 4, 5, or all) of the heavy and/or light CDR sequences in SEQ ID NO: 193 (e.g., amino acid residues 54-58, 73-89, 122-127, 177-187, 203-209, and/or 242-250 of SEQ ID NO: 193).

In other embodiments, the CAR-expressing cells can specifically bind to CD123, e.g., can include a CAR molecule (e.g., any of the CAR123-1 ro CAR123-4 and hzCAR123-1 to hzCAR123-32), or an antigen binding domain according to Tables 2, 6, and 9 of WO2016/028896, incorporated herein by reference. The amino acid and nucleotide sequences encoding the CD123 CAR molecules and antigen binding domains (e.g., including one, two, three VH CDRs; and one, two, three VL CDRs according to Kabat or Chothia), as specified in WO2016/028896, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 194-413, or a sequence substantially identical thereto.

In other embodiments, the CAR-expressing cells can specifically bind to EGFRvIII, e.g., can include a CAR molecule, or an antigen binding domain according to Table 2 or SEQ ID NO:11 of WO 2014/130657, incorporated herein by reference. The amino acid and nucleotide sequences encoding the EGFRvIII CAR molecules and antigen binding domains (e.g., including one, two, three VH CDRs; and one, two, three VL CDRs according to Kabat or Chothia), as specified in WO 2014/130657, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 414-474, or a sequence substantially identical thereto.

In certain embodiments, the CAR molecule or antigen binding domain comprises a leader sequence, e.g., amino acid residues 1-21 of SEQ ID NOs: 418, 424, 430, 436, 442, 448, 454, 460, 466, or 472. In other embodiments, the CAR molecule or antigen binding domain comprises a polyhistidine tag sequence, e.g., amino acid residues 268-277 of SEQ ID NOs: 418, 424, 430, 436, 442, 448, 454, or 460, amino acid residues 265-274 of SEQ ID NO: 466, or amino acid residues 262-269 of SEQ ID NO: 472.

In some embodiments, the CAR molecule or antigen binding domain comprises one or more (e.g., 2, 3, 4, 5, or all) of the heavy and/or light CDR sequences in SEQ ID NO: 420 (e.g., amino acid residues 52-56, 71-87, 120-123, 179-194, 210-216, and/or 249-257 of SEQ ID NO: 420). In some embodiments, the CAR molecule or antigen binding domain comprises one or more (e.g., 2, 3, 4, 5, or all) of the heavy and/or light CDR sequences in SEQ ID NO: 426 (e.g., amino acid residues 45-60, 76-82, 115-123, 184-188, 203-219, and/or 251-256 of SEQ ID NO: 426). In some embodiments, the CAR molecule or antigen binding domain comprises one or more (e.g., 2, 3, 4, 5, or all) of the heavy and/or light CDR sequences in SEQ ID NO: 432 (e.g., amino acid residues 52-56, 71-87, 120-124, 179-194, 210-216, and/or 249-257 of SEQ ID NO: 432). In some embodiments, the CAR molecule or antigen binding domain comprises one or more (e.g., 2, 3, 4, 5, or all) of the heavy and/or light CDR sequences in SEQ ID NO: 438 (e.g., amino acid residues 45-60, 76-82, 115-123, 184-188, 203-219, and/or 252-256 of SEQ ID NO: 438). In some embodiments, the CAR molecule or antigen binding domain comprises one or more (e.g., 2, 3, 4, 5, or all) of the heavy and/or light CDR sequences in SEQ ID NO: 444 (e.g., amino acid residues 52-56, 71-87, 120-124, 179-194, 210-216, and/or 249-257 of SEQ ID NO: 444). In some embodiments, the CAR molecule or antigen binding domain comprises one or more (e.g., 2, 3, 4, 5, or all) of the heavy and/or light CDR sequences in SEQ ID NO: 450 (e.g., amino acid residues 52-56, 71-87, 120-124, 179-194, 210-216, and/or 249-257 of SEQ ID NO: 450). In some embodiments, the CAR molecule or antigen binding domain comprises one or more (e.g., 2, 3, 4, 5, or all) of the heavy and/or light CDR sequences in SEQ ID NO: 456 (e.g., amino acid residues 45-60, 76-82, 115-123, 184-188, 203-219, and/or 252-256 of SEQ ID NO: 456). In some embodiments, the CAR molecule or antigen binding domain comprises one or more (e.g., 2, 3, 4, 5, or all) of the heavy and/or light CDR sequences in SEQ ID NO: 462 (e.g., amino acid residues 45-60, 76-82, 115-123, 184-188, 203-219, and/or 252-256 of SEQ ID NO: 462). In some embodiments, the CAR molecule or antigen binding domain comprises one or more (e.g., 2, 3, 4, 5, or all) of the heavy and/or light CDR sequences in SEQ ID NO: 468 (e.g., amino acid residues 52-56, 71-87, 119-124, 176-191, 207-213, and/or 246-254 of SEQ ID NO: 468).

In other embodiments, the CAR-expressing cells can specifically bind to CD33, e.g., can include a CAR molecule (e.g., any of CAR33-1 to CAR-33-9), or an antigen binding domain according to Table 2 or 9 of WO2016/014576, incorporated herein by reference. The amino acid and nucleotide sequences encoding the CD33 CAR molecules and antigen binding domains (e.g., including one, two, three VH CDRs; and one, two, three VL CDRs according to Kabat or Chothia), as specified in WO2016/014576, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 475-533, or a sequence substantially identical thereto. In other embodiments, the CAR-expressing cells can specifically bind to mesothelin, e.g., can include a CAR molecule, or an antigen binding domain according to Tables 2-3 of WO 2015/090230, incorporated herein by reference. The amino acid and nucleotide sequences encoding the mesothelin CAR molecules and antigen binding domains (e.g., including one, two, three VH CDRs; and one, two, three VL CDRs according to Kabat or Chothia), as specified in WO 2015/090230, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 534-625, or a sequence substantially identical thereto.

In some embodiments, the CAR molecule or antigen binding domain comprises one or more (e.g., 2, 3, 4, 5, or all) of the heavy and/or light CDR sequences in SEQ ID NO: 534 (e.g., amino acid residues 26-35, 50-66, 99-106, 161-171, 187-193, and/or 226-234 of SEQ ID NO: 534). In some embodiments, the CAR molecule or antigen binding domain comprises one or more (e.g., 2, 3, 4, 5, or all) of the heavy and/or light CDR sequences in SEQ ID NO: 535 (e.g., amino acid residues 47-56, 71-87, 120-127, 182-192, 208-214, and/or 247-255 of SEQ ID NO: 535). In some embodiments, the CAR molecule or antigen binding domain comprises one or more (e.g., 2, 3, 4, 5, or all) of the heavy and/or light CDR sequences in SEQ ID NO: 536 (e.g., amino acid residues 26-35, 50-66, 99-115, 170-180, 196-202, and/or 235-243 of SEQ ID NO: 536). In some embodiments, the CAR molecule or antigen binding domain comprises one or more (e.g., 2, 3, 4, 5, or all) of the heavy and/or light CDR sequences in SEQ ID NO: 537 (e.g., amino acid residues 47-56, 71-87, 120-136, 191-201, 217-223, and/or 256-264 of SEQ ID NO: 537). In some embodiments, the CAR molecule or antigen binding domain comprises one or more (e.g., 2, 3, 4, 5, or all) of the heavy and/or light CDR sequences in SEQ ID NO: 538 (e.g., amino acid residues 26-35, 50-66, 99-109, 164-174, 190-196, and/or 229-236 of SEQ ID NO: 538). In some embodiments, the CAR molecule or antigen binding domain comprises one or more (e.g., 2, 3, 4, 5, or all) of the heavy and/or light CDR sequences in SEQ ID NO: 539 (e.g., amino acid residues 47-56, 71-87, 120-130, 185-195, 211-217, and/or 250-257 of SEQ ID NO: 539). In some embodiments, the CAR molecule or antigen binding domain comprises one or more (e.g., 2, 3, 4, 5, or all) of the heavy and/or light CDR sequences in SEQ ID NO: 540 (e.g., amino acid residues 26-35, 50-66, 99-103, 158-168, 184-189, and/or 223-232 of SEQ ID NO: 540). In some embodiments, the CAR molecule or antigen binding domain comprises one or more (e.g., 2, 3, 4, 5, or all) of the heavy and/or light CDR sequences in SEQ ID NO: 541 (e.g., amino acid residues 47-56, 71-87, 120-124, 179-189, 205-210, and/or 244-253 of SEQ ID NO: 541). In some embodiments, the CAR molecule or antigen binding domain comprises one or more (e.g., 2, 3, 4, 5, or all) of the heavy and/or light CDR sequences in SEQ ID NO: 542 (e.g., amino acid residues 26-35, 50-65, 99-104, 159-169, 185-191, and/or 224-231 of SEQ ID NO: 542). In some embodiments, the CAR molecule or antigen binding domain comprises one or more (e.g., 2, 3, 4, 5, or all) of the heavy and/or light CDR sequences in SEQ ID NO: 543 (e.g., amino acid residues 47-56, 71-86, 120-125, 180-190, 206-212, and/or 245-252 of SEQ ID NO: 543). In some embodiments, the CAR molecule or antigen binding domain comprises one or more (e.g., 2, 3, 4, 5, or all) of the heavy and/or light CDR sequences in SEQ ID NO: 544 (e.g., amino acid residues 26-35, 50-66, 99-115, 170-180, 196-202, and/or 235-243 of SEQ ID NO: 544). In some embodiments, the CAR molecule or antigen binding domain comprises one or more (e.g., 2, 3, 4, 5, or all) of the heavy and/or light CDR sequences in SEQ ID NO: 545 (e.g., amino acid residues 47-56, 71-87, 120-136, 191-201, 217-223, and/or 256-264 of SEQ ID NO: 545). In some embodiments, the CAR molecule or antigen binding domain comprises one or more (e.g., 2, 3, 4, 5, or all) of the heavy and/or light CDR sequences in SEQ ID NO: 546 (e.g., amino acid residues 26-35, 50-66, 98-110, 165-176, 192-198, and/or 231-240 of SEQ ID NO: 546). In some embodiments, the CAR molecule or antigen binding domain comprises one or more (e.g., 2, 3, 4, 5, or all) of the heavy and/or light CDR sequences in SEQ ID NO: 547 (e.g., amino acid residues 47-56, 71-87, 120-131, 186-197, 213-219, and/or 252-261 of SEQ ID NO: 547). In some embodiments, the CAR molecule or antigen binding domain comprises one or more (e.g., 2, 3, 4, 5, or all) of the heavy and/or light CDR sequences in SEQ ID NO: 548 (e.g., amino acid residues 26-35, 50-66, 99-108, 163-173, 189-195, and/or 228-236 of SEQ ID NO: 548). In some embodiments, the CAR molecule or antigen binding domain comprises one or more (e.g., 2, 3, 4, 5, or all) of the heavy and/or light CDR sequences in SEQ ID NO: 549 (e.g., amino acid residues 47-56, 71-87, 120-129, 184-194, 210-216, and/or 249-257 of SEQ ID NO: 549). In some embodiments, the CAR molecule or antigen binding domain comprises one or more (e.g., 2, 3, 4, 5, or all) of the heavy and/or light CDR sequences in SEQ ID NO: 550 (e.g., amino acid residues 26-35, 50-66, 99-110, 165-175, 191-197, and/or 230-238 of SEQ ID NO: 550). In some embodiments, the CAR molecule or antigen binding domain comprises one or more (e.g., 2, 3, 4, 5, or all) of the heavy and/or light CDR sequences in SEQ ID NO: 551 (e.g., amino acid residues 47-56, 71-87, 120-131, 186-196, 212-218, and/or 251-259 of SEQ ID NO: 551). In some embodiments, the CAR molecule or antigen binding domain comprises one or more (e.g., 2, 3, 4, 5, or all) of the heavy and/or light CDR sequences in SEQ ID NO: 552 (e.g., amino acid residues 26-35, 50-65, 99-111, 166-182, 198-204, and/or 237-245 of SEQ ID NO: 552). In some embodiments, the CAR molecule or antigen binding domain comprises one or more (e.g., 2, 3, 4, 5, or all) of the heavy and/or light CDR sequences in SEQ ID NO: 553 (e.g., amino acid residues 47-56, 71-86, 120-132, 187-203, 219-225, and/or 258-266 of SEQ ID NO: 553). In some embodiments, the CAR molecule or antigen binding domain comprises one or more (e.g., 2, 3, 4, 5, or all) of the heavy and/or light CDR sequences in SEQ ID NO: 554 (e.g., amino acid residues 26-35, 50-66, 99-104, 159-169, 185-191, and/or 224-231 of SEQ ID NO: 554). In some embodiments, the CAR molecule or antigen binding domain comprises one or more (e.g., 2, 3, 4, 5, or all) of the heavy and/or light CDR sequences in SEQ ID NO: 555 (e.g., amino acid residues 47-56, 71-87, 120-125, 180-190, 206-212, and/or 245-252 of SEQ ID NO: 555). In some embodiments, the CAR molecule or antigen binding domain comprises one or more (e.g., 2, 3, 4, 5, or all) of the heavy and/or light CDR sequences in SEQ ID NO: 556 (e.g., amino acid residues 26-35, 50-66, 99-107, 162-172, 188-194, and/or 227-236 of SEQ ID NO: 556). In some embodiments, the CAR molecule or antigen binding domain comprises one or more (e.g., 2, 3, 4, 5, or all) of the heavy and/or light CDR sequences in SEQ ID NO: 557 (e.g., amino acid residues 47-56, 71-87, 120-128, 183-193, 209-215, and/or 248-257 of SEQ ID NO: 557). In some embodiments, the CAR molecule or antigen binding domain comprises one or more (e.g., 2, 3, 4, 5, or all) of the heavy and/or light CDR sequences in SEQ ID NO: 558 (e.g., amino acid residues 26-35, 50-66, 99-110, 165-176, 192-198, and/or 231-239 of SEQ ID NO: 558). In some embodiments, the CAR molecule or antigen binding domain comprises one or more (e.g., 2, 3, 4, 5, or all) of the heavy and/or light CDR sequences in SEQ ID NO: 559 (e.g., amino acid residues 47-56, 71-87, 120-131, 186-197, 213-219, and/or 252-260 of SEQ ID NO: 559). In some embodiments, the CAR molecule or antigen binding domain comprises one or more (e.g., 2, 3, 4, 5, or all) of the heavy and/or light CDR sequences in SEQ ID NO: 560 (e.g., amino acid residues 26-35, 50-66, 99-111, 166-176, 192-198, and/or 231-239 of SEQ ID NO: 560). In some embodiments, the CAR molecule or antigen binding domain comprises one or more (e.g., 2, 3, 4, 5, or all) of the heavy and/or light CDR sequences in SEQ ID NO: 561 (e.g., amino acid residues 47-56, 71-87, 120-132, 187-197, 213-219, and/or 252-260 of SEQ ID NO: 561). In some embodiments, the CAR molecule or antigen binding domain comprises one or more (e.g., 2, 3, 4, 5, or all) of the heavy and/or light CDR sequences in SEQ ID NO: 562 (e.g., amino acid residues 26-35, 50-65, 99-111, 160-169, 186-192, and/or 225-244 of SEQ ID NO: 562). In some embodiments, the CAR molecule or antigen binding domain comprises one or more (e.g., 2, 3, 4, 5, or all) of the heavy and/or light CDR sequences in SEQ ID NO: 563 (e.g., amino acid residues 47-56, 71-86, 120-132, 181-191, 207-213, and/or 246-255 of SEQ ID NO: 563). In some embodiments, the CAR molecule or antigen binding domain comprises one or more (e.g., 2, 3, 4, 5, or all) of the heavy and/or light CDR sequences in SEQ ID NO: 564 (e.g., amino acid residues 26-35, 50-66, 99-112, 161-171, 187-193, and/or 226-236 of SEQ ID NO: 564). In some embodiments, the CAR molecule or antigen binding domain comprises one or more (e.g., 2, 3, 4, 5, or all) of the heavy and/or light CDR sequences in SEQ ID NO: 565 (e.g., amino acid residues 47-56, 71-87, 120-133, 182-192, 208-214, and/or 247-257 of SEQ ID NO: 565). In some embodiments, the CAR molecule or antigen binding domain comprises one or more (e.g., 2, 3, 4, 5, or all) of the heavy and/or light CDR sequences in SEQ ID NO: 566 (e.g., amino acid residues 26-35, 50-66, 99-112, 161-171, 187-193, and/or 226-236 of SEQ ID NO: 566). In some embodiments, the CAR molecule or antigen binding domain comprises one or more (e.g., 2, 3, 4, 5, or all) of the heavy and/or light CDR sequences in SEQ ID NO: 567 (e.g., amino acid residues 47-56, 71-87, 120-133, 182-192, 208-214, and/or 247-257 of SEQ ID NO: 567). In some embodiments, the CAR molecule or antigen binding domain comprises one or more (e.g., 2, 3, 4, 5, or all) of the heavy and/or light CDR sequences in SEQ ID NO: 568 (e.g., amino acid residues 26-35, 50-66, 99-111, 166-177, 193-199, and/or 232-241 of SEQ ID NO: 568). In some embodiments, the CAR molecule or antigen binding domain comprises one or more (e.g., 2, 3, 4, 5, or all) of the heavy and/or light CDR sequences in SEQ ID NO: 569 (e.g., amino acid residues 47-56, 71-87, 120-132, 187-198, 214-220, and/or 253-262 of SEQ ID NO: 569). In some embodiments, the CAR molecule or antigen binding domain comprises one or more (e.g., 2, 3, 4, 5, or all) of the heavy and/or light CDR sequences in SEQ ID NO: 570 (e.g., amino acid residues 26-35, 50-66, 99-110, 165-176, 192-198, and/or 231-240 of SEQ ID NO: 570). In some embodiments, the CAR molecule or antigen binding domain comprises one or more (e.g., 2, 3, 4, 5, or all) of the heavy and/or light CDR sequences in SEQ ID NO: 571 (e.g., amino acid residues 47-56, 71-87, 120-131, 186-197, 213-219, and/or 252-261 of SEQ ID NO: 571). In some embodiments, the CAR molecule or antigen binding domain comprises one or more (e.g., 2, 3, 4, 5, or all) of the heavy and/or light CDR sequences in SEQ ID NO: 572 (e.g., amino acid residues 26-35, 50-66, 99-111, 166-176, 192-198, and/or 231-239 of SEQ ID NO: 572). In some embodiments, the CAR molecule or antigen binding domain comprises one or more (e.g., 2, 3, 4, 5, or all) of the heavy and/or light CDR sequences in SEQ ID NO: 573 (e.g., amino acid residues 47-56, 71-87, 120-132, 187-197, 213-219, and/or 252-260 of SEQ ID NO: 573). In some embodiments, the CAR molecule or antigen binding domain comprises one or more (e.g., 2, 3, 4, 5, or all) of the heavy and/or light CDR sequences in SEQ ID NO: 574 (e.g., amino acid residues 26-35, 50-66, 99-108, 158-167, 183-190, and/or 222-230 of SEQ ID NO: 574). In some embodiments, the CAR molecule or antigen binding domain comprises one or more (e.g., 2, 3, 4, 5, or all) of the heavy and/or light CDR sequences in SEQ ID NO: 575 (e.g., amino acid residues 47-56, 71-86, 120-129, 179-188, 204-210, and/or 243-251 of SEQ ID NO: 575).

In some embodiments, the CAR molecule or antigen binding domain comprises a linker sequence (e.g., amino acid residues 118-137 of SEQ ID NO: 534, amino acid residues 139-158 of SEQ ID NO: 535, amino acid residues 127-146 of SEQ ID NO: 536, amino acid residues 148-167 of SEQ ID NO: 537, amino acid residues 121-140 of SEQ ID NO: 538, amino acid residues 142-161 of SEQ ID NO: 539, amino acid residues 115-134 of SEQ ID NO: 540, amino acid residues 136-155 of SEQ ID NO: 541, amino acid residues 116-135 of SEQ ID NO: 542, amino acid residues 137-156 of SEQ ID NO: 543, amino acid residues 127-146 of SEQ ID NO: 544, amino acid residues 148-167 of SEQ ID NO: 545, amino acid residues 122-141 of SEQ ID NO: 546, amino acid residues 143-162 of SEQ ID NO: 547, amino acid residues 120-139 of SEQ ID NO: 548, amino acid residues 141-160 of SEQ ID NO: 549, amino acid residues 122-141 of SEQ ID NO: 550, amino acid residues 143-162 of SEQ ID NO: 551, amino acid residues 123-142 of SEQ ID NO: 552, amino acid residues 144-163 of SEQ ID NO: 553, amino acid residues 116-135 of SEQ ID NO: 554, amino acid residues 137-156 of SEQ ID NO: 555, amino acid residues 119-138 of SEQ ID NO: 556, amino acid residues 140-159 of SEQ ID NO: 557, amino acid residues 132-141 of SEQ ID NO: 558, amino acid residues 143-162 of SEQ ID NO: 559, amino acid residues 123-142 of SEQ ID NO: 560, amino acid residues 144-163 of SEQ ID NO: 561, amino acid residues 123-137 of SEQ ID NO: 562, amino acid residues 144-158 of SEQ ID NO: 563, amino acid residues 124-138 of SEQ ID NO: 564, amino acid residues 145-159 of SEQ ID NO: 565, amino acid residues 124-138 of SEQ ID NO: 566, amino acid residues 145-159 of SEQ ID NO: 567, amino acid residues 123-142 of SEQ ID NO: 568, amino acid residues 144-163 of SEQ ID NO: 569, amino acid residues 122-141 of SEQ ID NO; 570, amino acid residues 143-162 of SEQ ID NO: 571, amino acid residues 123-142 of SEQ ID NO: 572, amino acid residues 144-163 of SEQ ID NO: 573, or amino acid residues 141-155 of SEQ ID NO: 575).

In some embodiments, the CAR molecule or antigen binding domain comprises a leader sequence (e.g., amino acid residues 1-21 of SEQ ID NOs: 535, 537, 539, 541, 543, 545, 547, 549, 551, 553, 555, 557, 559, 561, 563, 565, 567, 569, 571, 573, or 575, or encoded by nucleotide residues 1-63 of SEQ ID NOs: 577, 579, 581, 583, 585, 587, 589, 591, 593, 595, 597, 599, 601, 603, 605, 607, 609, 611, 613, 615, 617, 619, 621, 623, or 625).

In other embodiments, the CAR-expressing cells can specifically bind to BCMA, e.g., can include a CAR molecule, or an antigen binding domain according to Table 1 or 16, SEQ ID NO: 271 or SEQ ID NO: 273 of WO2016/014565, incorporated herein by reference. The amino acid and nucleotide sequences encoding the BCMA CAR molecules and antigen binding domains (e.g., including one, two, three VH CDRs; and one, two, three VL CDRs according to Kabat or Chothia), as specified in WO2016/014565, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 626-859, or a sequence substantially identical thereto.

In other embodiments, the CAR-expressing cells can specifically bind to CLL-1, e.g., can include a CAR molecule, or an antigen binding domain according to Table 2 of WO2016/014535, incorporated herein by reference. The amino acid and nucleotide sequences encoding the CLL-1 CAR molecules and antigen binding domains (e.g., including one, two, three VH CDRs; and one, two, three VL CDRs according to Kabat or Chothia), as specified in WO2016/014535, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 860-941, or a sequence substantially identical thereto.

In other embodiments, the CAR-expressing cells can specifically bind to GFR ALPHA-4, e.g., can include a CAR molecule, or an antigen binding domain according to Table 2 of WO2016/025880, incorporated herein by reference. The amino acid and nucleotide sequences encoding the GFR ALPHA-4 CAR molecules and antigen binding domains (e.g., including one, two, three VH CDRs; and one, two, three VL CDRs according to Kabat or Chothia), as specified in WO2016/025880, are provided in the Sequence Listing submitted herewith. Amino and nucleotide sequences identical and substantially identical to the aforesaid sequences provided in the Sequence Listing are specifically incorporated into the instant specification.

In certain embodiments, the CAR molecule or antigen binding domain comprises an amino acid sequence, or is encoded by a nucleotide sequence, according to any of SEQ ID NOs: 942-981, or a sequence substantially identical thereto.

In one embodiment, the antigen binding domain of any of the CAR molecules described herein (e.g., any of CD19, CD123, EGFRvIII, CD33, mesothelin, BCMA, and GFR ALPHA-4) comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antigen binding domain listed above. In one embodiment, the antigen binding domain comprises a heavy chain variable region and/or a variable light chain region of an antibody listed or described above.

In one aspect, the anti-tumor antigen binding domain is a fragment, e.g., a single chain variable fragment (scFv). In one aspect, the anti-a cancer associate antigen as described herein binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a cancer associate antigen as described herein protein with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as (Gly$_4$Ser)n, where n is a positive integer equal to or greater than 1 (SEQ ID NO:26). In one embodiment, the linker can be (Gly$_4$Ser)$_4$ (SEQ ID NO:27) or (Gly$_4$Ser)$_3$ (SEQ ID NO:25). Variation in the linker length may retain or enhance activity, giving rise to superior efficacy in activity studies.

In another aspect, the antigen binding domain is a T cell receptor ("TCR"), or a fragment thereof, for example, a single chain TCR (scTCR). Methods to make such TCRs are known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contains the Vα and Vβ genes from a T cell clone linked by a linker (e.g., a flexible peptide). This approach is very useful to cancer associated target that itself is intracellar, however, a fragment of such antigen (peptide) is presented on the surface of the cancer cells by MHC.

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect, the amino acid sequence of the transmembrane domain may be modified or substituted so as to minimize interactions with the binding domains of the native binding partner present in the same CART.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIR2DS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one embodiment, the hinge or spacer comprises (e.g., consists of) the amino acid sequence of SEQ ID NO:2. In one aspect, the transmembrane domain comprises (e.g., consists of) a transmembrane domain of SEQ ID NO: 6.

In one aspect, the hinge or spacer comprises an IgG4 hinge. For example, in one embodiment, the hinge or spacer comprises a hinge of the amino acid sequence

```
                                            (SEQ ID NO: 36)
ESKYGPPCPPCPAPEFLGGPSVFLFPPKPKDTLMISRTPEVTCVVVDVSQ

EDPEVQFNWYVDGVEVHNAKTKPREEQFNSTYRVVSVLTVLHQDWLNGKE

YKCKVSNKGLPSSIEKTISKAKGQPREPQVYTLPPSQEEMTKNQVSLTCL

VKGFYPSDIAVEWESNGQPENNYKTTPPVLDSDGSFFLYSRLTVDKSRWQ

EGNVFSCSVMHEALHNHYTQKSLSLSLGKM.
```

In some embodiments, the hinge or spacer comprises a hinge encoded by a nucleotide sequence of

```
                                            (SEQ ID NO: 37)
GAGAGCAAGTACGGCCCTCCCTGCCCCCCTTGCCCTGCCCCCGAGTTCCT

GGGCGGACCCAGCGTGTTCCTGTTCCCCCCCAAGCCCAAGGACACCCTGA

TGATCAGCCGGACCCCCGAGGTGACCTGTGTGGTGGTGGACGTGTCCCAG

GAGGACCCCGAGGTCCAGTTCAACTGGTACGTGGACGGCGTGGAGGTGCA

CAACGCCAAGACCAAGCCCCGGGAGGAGCAGTTCAATAGCACCTACCGGG

TGGTGTCCGTGCTGACCGTGCTGCACCAGGACTGGCTGAACGGCAAGGAA

TACAAGTGTAAGGTGTCCAACAAGGGCCTGCCCAGCAGCATCGAGAAAAC

CATCAGCAAGGCCAAGGGCCAGCCTCGGGAGCCCCAGGTGTACACCCTGC

CCCCTAGCCAAGAGGAGATGACCAAGAACCAGGTGTCCCTGACCTGCCTG
```

-continued

```
GTGAAGGGCTTCTACCCCAGCGACATCGCCGTGGAGTGGGAGAGCAACGG

CCAGCCCGAGAACAACTACAAGACCACCCCCCCTGTGCTGGACAGCGACG

GCAGCTTCTTCCTGTACAGCCGGCTGACCGTGGACAAGAGCCGGTGGCAG

GAGGGCAACGTCTTTAGCTGCTCCGTGATGCACGAGGCCCTGCACAACCA

CTACACCCAGAAGAGCCTGAGCCTGTCCCTGGGCAAGATG.
```

In one aspect, the hinge or spacer comprises an IgD hinge. For example, in one embodiment, the hinge or spacer comprises a hinge of the amino acid sequence (SEQ ID NO: 23)
```
RWPESPKAQASSVPTAQPQAEGSLAKATTAPATTRNTGRGGEEKKKEKEK

EEQEERETKTPECPSHTQPLGVYLLTPAVQDLWLRDKATFTCFVVGSDLK

DAHLTWEVAGKVPTGGVEEGLLERHSNGSQSQHSRLTLPRSLWNAGTSVT

CTLNHPSLPPQRLMALREPAAQAPVKLSLNLLASSDPPEAASWLLCEVSG

FSPPNILLMWLEDQREVNTSGFAPARPPPQPGSTTFWAWSVLRVPAPPSP

QPATYTCVVSHEDSRTLLNASRSLEVSYVTDH.
```

In some embodiments, the hinge or spacer comprises a hinge encoded by a nucleotide sequence of (SEQ ID NO: 24)
```
AGGTGGCCCGAAAGTCCCAAGGCCCAGGCATCTAGTGTTCCTACTGCACA

GCCCCAGGCAGAAGGCAGCCTAGCCAAAGCTACTACTGCACCTGCCACTA

CGCGCAATACTGGCCGTGGCGGGGAGGAGAAGAAAAAGGAGAAAGAGAAA

GAAGAACAGGAAGAGAGGGAGACCAAGACCCCTGAATGTCCATCCCATAC

CCAGCCGCTGGGCGTCTATCTCTTGACTCCCGCAGTACAGGACTTGTGGC

TTAGAGATAAGGCCACCTTTACATGTTTCGTCGTGGGCTCTGACCTGAAG

GATGCCCATTTGACTTGGGAGGTTGCCGGAAAGGTACCCACAGGGGGGT

TGAGGAAGGGTTGCTGGAGCGCCATTCCAATGGCTCTCAGAGCCAGCACT

CAAGACTCACCCTTCCGAGATCCCTGTGGAACGCCGGGACCTCTGTCACA

TGTACTCTAAATCATCCTAGCCTGCCCCCACAGCGTCTGATGGCCCTTAG

AGAGCCAGCCGCCCAGGCACCAGTTAAGCTTAGCCTGAATCTGCTCGCCA

GTAGTGATCCCCCAGAGGCCGCCAGCTGGCTCTTATGCGAAGTGTCCGGC

TTTAGCCCGCCCAACATCTTGCTCATGTGGCTGGAGGACCAGCGAGAAGT

GAACACCAGCGGCTTCGCTCCAGCCCGGCCCCCACCCCAGCCGGGTTCTA

CCACATTCTGGGCCTGGAGTGTCTTAAGGGTCCCAGCACCACCTAGCCCC

CAGCCAGCCACATACACCTGTGTTGTGTCCCATGAAGATAGCAGGACCCT

GCTAAATGCTTCTAGGAGTCTGGAGGTTTCCTACGTGACTGACCATT.
```

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO: 14). In some embodiments, the linker is encoded by a nucleotide sequence of GGTGGCGGAGGTTCTGGAGGTGGAGGTTCC (SEQ ID NO: 19).

In one aspect, the hinge or spacer comprises a KIR2DS2 hinge.

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced.

Examples of intracellular signaling domains for use in a CAR described herein include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, CD278 (also known as "ICOS"), FcεcRI, DAP10, DAP12, and CD66d. In one embodiment, a CAR of the invention comprises an intracellular signaling domain, e.g., a primary signaling domain of CD3-zeta, e.g., a CD3-zeta sequence described herein.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

Costimulatory Signaling Domain

The intracellular signalling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. In one embodiment, the intracellular domain is designed to comprise the signaling domain of CD3-zeta and the signaling domain of CD28.

In one aspect, the intracellular domain is designed to comprise the signaling domain of CD3-zeta and the signaling domain of ICOS.

A costimulatory molecule can be a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). Further examples of such costimulatory molecules include CDS, ICAM-1, GITR, BAFFR, HVEM (LIGHTR), SLAMF7, NKp80 (KLRF1), NKp30, NKp44, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, NKG2D, NKG2C and PAG/Cbp.

The intracellular signaling sequences within the cytoplasmic portion of the CAR may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 7. In one aspect, the signaling domain of CD3-zeta is a signaling domain of SEQ ID NO: 9.

In one aspect, the intracellular signaling domain is designed to comprise the signaling domain of CD3-zeta and the signaling domain of CD27. In one aspect, the signaling domain of CD27 comprises an amino acid sequence of (SEQ ID NO: 16)
QRRKYRSNKGESPVEPAEPCRYSCPREEEGSTIPIQEDYRKPEPACSP.

In one aspect, the signalling domain of CD27 is encoded by a nucleic acid sequence of (SEQ ID NO: 15)
AGGAGTAAGAGGAGCAGGCTCCTGCACAGTGACTACATGAACATGACTCC

CCGCCGCCCCGGGCCCACCCGCAAGCATTACCAGCCCTATGCCCCACCAC

GCGACTTCGCAGCCTATCGCTCC.

In one aspect, the CAR-expressing cell described herein can further comprise a second CAR, e.g., a second CAR that includes a different antigen binding domain, e.g., to the same target or a different target (e.g., a target other than a cancer associated antigen described herein or a different cancer associated antigen described herein, e.g., CD19, CD33, CLL-1, CD34, FLT3, or folate receptor beta). In one embodiment, the second CAR includes an antigen binding domain to a target expressed the same cancer cell type as the cancer associated antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, ICOS, CD27 or OX-40, onto the first CAR, and the primary signaling domain, e.g., CD3 zeta, on the second CAR can limit the CAR activity to cells where both targets are expressed. In one embodiment, the CAR expressing cell comprises a first cancer associated antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In another aspect, the disclosure features a population of CAR-expressing cells, e.g., CART cells. In some embodiments, the population of CAR-expressing cells comprises a mixture of cells expressing different CARs. For example, in one embodiment, the population of CART cells can include a first cell expressing a CAR having an antigen binding domain to a cancer associated antigen described herein, and a second cell expressing a CAR having a different antigen binding domain, e.g., an antigen binding domain to a different a cancer associated antigen described herein, e.g., an antigen binding domain to a cancer associated antigen described herein that differs from the cancer associate antigen bound by the antigen binding domain of the CAR expressed by the first cell. As another example, the population of CAR-expressing cells can include a first cell expressing a CAR that includes an antigen binding domain to a cancer associated antigen described herein, and a second cell expressing a CAR that includes an antigen binding domain to a target other than a cancer associate antigen as described herein. In one embodiment, the population of CAR-expressing cells includes, e.g., a first cell expressing a CAR that includes a primary intracellular signaling domain, and a second cell expressing a CAR that includes a secondary signaling domain.

In another aspect, the disclosure features a population of cells wherein at least one cell in the population expresses a CAR having an antigen binding domain to a cancer associated antigen described herein, and a second cell expressing another agent, e.g., an agent which enhances the activity of a CAR-expressing cell. For example, in one embodiment, the agent can be an agent which inhibits an inhibitory molecule. Inhibitory molecules, e.g., PD-1, can, in some embodiments, decrease the ability of a CAR-expressing cell to mount an immune effector response. Examples of inhibitory molecules include PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGF (e.g., TGFbeta). In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4 and TGF beta, or a fragment of any of these, and a second polypeptide which is an intracellular signaling domain described herein (e.g., comprising a costimulatory domain (e.g., 41BB, CD27, OX40 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28 signaling domain described herein and/or a CD3 zeta signaling domain described herein).

Exemplary CAR Molecules

The sequences of anti-CD19 binding domains are provided above in Table 1. Full CAR constructs can be generated using any of the antigen binding domains described in Table 1 with one or more additional CAR component provided below.

leader (amino acid sequence) (SEQ ID NO: 1)

MALPVTALLLPLALLLHAARP leader (nucleic acid sequence) (SEQ ID NO: 12)

ATGGCCCTGCCTGTGACAGCCCTGCTGCTGCCTCTGGCTCTGCTGCTGCA

TGCCGCTAGACCC

CD8 hinge (amino acid sequence) (SEQ ID NO: 2)

TTTPAPRPPTPAPTIASQPLSLRPEACRPAAGGAVHTRGLDFACD

CD8 hinge (nucleic acid sequence) (SEQ ID NO: 13)

ACCACGACGCCAGCGCCGCGACCACCAACACCGGCGCCCACCATCGCGTC

GCAGCCCCTGTCCCTGCGCCCAGAGGCGTGCCGGCCAGCGGCGGGGGGCG

CAGTGCACACGAGGGGGCTGGACTTCGCCTGTGAT

CD8 transmembrane (amino acid sequence) (SEQ ID NO: 6)

IYIWAPLAGTCGVLLLSLVITLYC transmembrane (nucleic acid sequence) (SEQ ID NO: 17)

ATCTACATCTGGGCGCCCTTGGCCGGGACTTGTGGGGTCCTTCTCCTGTC

ACTGGTTATCACCCTTTACTGC 4-1BB Intracellular domain (amino acid sequence) (SEQ ID NO: 7)

KRGRKKLLYIFKQPFMRPVQTTQEEDGCSCRFPEEEEGGCEL 4-1BB Intracellular domain (nucleic acid sequence) (SEQ ID NO: 18)

AAACGGGGCAGAAAGAAACTCCTGTATATATTCAAACAACCATTTATGAG

ACCAGTACAAACTACTCAAGAGGAAGATGGCTGTAGCTGCCGATTTCCAG

AAGAAGAAGAAGGAGGATGTGAACTG

CD3 zeta domain (amino acid sequence) (SEQ ID NO: 9)

RVKFSRSADAPAYKQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence) (SEQ ID NO: 20)

AGAGTGAAGTTCAGCAGGAGCGCAGACGCCCCCGCGTACAAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

CD3 zeta domain (amino acid sequence; NCBI Reference Sequence NM_000734.3) (SEQ ID NO:10)

RVKFSRSADAPAYQQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence; NCBI Reference Sequence NM_000734.3); (SEQ ID NO:21)

AGAGTGAAGTTCAGCAGGAGCGCAGACGCCCCCGCGTACCAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

IgG4 Hinge (amino acid sequence) (SEQ ID NO:36)

ESKYGPPCPPCPAPEFLGGPSVFLFPPKPKDTLMISRTPEVTCVVVDVSQ
EDPEVQFNWYVDGVEVHNAKTKPREEQFNSTYRVVSVLTVLHQDWLNGKE
YKCKVSNKGLPSSIEKTISKAKGQPREPQVYTLPPSQEEMTKNQVSLTCL
VKGFYPSDIAVEWESNGQPENNYKTTPPVLDSDGSFFLYSRLTVDKSRWQ
EGNVFSCSVMHEALHNHYTQKSLSLSLGKM

IgG4 Hinge (nucleotide sequence) (SEQ ID NO:37)

GAGAGCAAGTACGGCCCTCCCTGCCCCCCTTGCCCTGCCCCGAGTTCCT

GGGCGGACCCAGCGTGTTCCTGTTCCCCCCAAGCCCAAGGACACCCTGA

TGATCAGCCGGACCCCCGAGGTGACCTGTGTGGTGGTGGACGTGTCCCAG

GAGGACCCCGAGGTCCAGTTCAACTGGTACGTGGACGGCGTGGAGGTGCA

CAACGCCAAGACCAAGCCCGGGAGGAGCAGTTCAATAGCACCTACCGGG

TGGTGTCCGTGCTGACCGTGCTGCACCAGGACTGGCTGAACGGCAAGGAA

TACAAGTGTAAGGTGTCCAACAAGGGCCTGCCCAGCAGCATCGAGAAAAC

CATCAGCAAGGCCAAGGGCCAGCCTCGGGAGCCCCAGGTGTACACCCTGC

CCCCTAGCCAAGAGGAGATGACCAAGAACCAGGTGTCCCTGACCTGCCTG

GTGAAGGGCTTCTACCCCAGCGACATCGCCGTGGAGTGGGAGAGCAACGG

CCAGCCCGAGAACAACTACAAGACCACCCCCCCTGTGCTGGACAGCGACG

GCAGCTTCTTCCTGTACAGCCGGCTGACCGTGGACAAGAGCCGGTGGCAG

GAGGGCAACGTCTTTAGCTGCTCCGTGATGCACGAGGCCCTGCACAACCA

CTACACCCAGAAGAGCCTGAGCCTGTCCCTGGGCAAGATG

EF1 alpha promoter (SEQ ID NO: 11)
CGTGAGGCTCCGGTGCCCGTCAGTGGGCAGAGCGCACATCGCCCACAGTC

CCCGAGAAGTTGGGGGGAGGGGTCGGCAATTGAACCGGTGCCTAGAGAAG

GTGGCGCGGGGTAAACTGGGAAAGTGATGTCGTGTACTGGCTCCGCCTTT

TTCCCGAGGGTGGGGGAGAACCGTATATAAGTGCAGTAGTCGCCGTGAAC

GTTCTTTTTCGCAACGGGTTTGCCGCCAGAACACAGGTAAGTGCCGTGTG

TGGTTCCCGCGGGCCTGGCCTCTTTACGGGTTATGGCCCTTGCGTGCCTT

GAATTACTTCCACCTGGCTGCAGTACGTGATTCTTGATCCCGAGCTTCGG

GTTGGAAGTGGGTGGGAGAGTTCGAGGCCTTGCGCTTAAGGAGCCCCTTC

GCCTCGTGCTTGAGTTGAGGCCTGGCCTGGGCGCTGGGGCCGCCGCGTGC

GAATCTGGTGGCACCTTCGCGCCTGTCTCGCTGCTTTCGATAAGTCTCTA

GCCATTTAAAATTTTTGATGACCTGCTGCGACGCTTTTTTTCTGGCAAGA

TAGTCTTGTAAATGCGGGCCAAGATCTGCACACTGGTATTTCGGTTTTTG

GGGCCGCGGGCGGCGACGGGGCCCGTGCGTCCCAGCGCACATGTTCGGCG

AGGCGGGGCCTGCGAGCGCGGCCACCGAGAATCGGACGGGGGTAGTCTCA

AGCTGGCCGGCCTGCTCTGGTGCCTGGCCTCGCGCCGCCGTGTATCGCCC

CGCCCTGGGCGGCAAGGCTGGCCCGGTCGGCACCAGTTGCGTGAGCGGAA

AGATGGCCGCTTCCCGGCCCTGCTGCAGGGAGCTCAAAATGGAGGACGCG

GCGCTCGGGAGAGCGGGCGGGTGAGTCACCCACACAAAGGAAAAGGGCCT

TTCCGTCCTCAGCCGTCGCTTCATGTGACTCCACGGAGTACCGGGCGCCG

TCCAGGCACCTCGATTAGTTCTCGAGCTTTTGGAGTACGTCGTCTTTAGG

TTGGGGGGAGGGGTTTTATGCGATGGAGTTTCCCCACACTGAGTGGGTGG

AGACTGAAGTTAGGCCAGCTTGGCACTTGATGTAATTCTCCTTGGAATTT

GCCCTTTTTGAGTTTGGATCTTGGTTCATTCTCAAGCCTCAGACAGTGGT

TCAAAGTTTTTTCTTCCATTTCAGGTGTCGTGA.

Gly/Ser (SEQ ID NO:25)

GGGGS

Gly/Ser (SEQ ID NO:26): This sequence may encompass 1-6 "Gly Gly Gly Gly Ser" repeating units

GGGGSGGGGS GGGGSGGGGS GGGGSGGGGS

Gly/Ser (SEQ ID NO:27)

GGGGSGGGGS GGGGSGGGGS

Gly/Ser (SEQ ID NO:28)

GGGGSGGGGS GGGGS

Gly/Ser (SEQ ID NO:29)

GGGS

PolyA (SEQ ID NO:30), polyA 1-5000
PolyA (SEQ ID NO:31), poly T 1-100
PolyA (SEQ ID NO:32), poly T 1-5000
PolyA (SEQ ID NO:33), Poly A 1-5000
PolyA (SEQ ID NO:34), Poly A 1-400
PolyA (SEQ ID NO:35), Poly A 1-2000

Gly/Ser (SEQ ID NO:38): This sequence may encompass 1-10 "Gly Gly Gly Ser" repeating units

GGGSGGGSGG GSGGGSGGGS GGGSGGGSGG GSGGGSGGGS

Exemplary CD19 CAR constructs that can be used in the methods described herein are shown in Table 4:

TABLE 4

CD19 CAR Constructs

| Name | SEQ ID | Sequence |
| --- | --- | --- |
| CAR 1 | | |
| CAR1 scFv domain | 39 | EIVMTQSPATLSLSPGERATLSCRASQDISKYLNWYQQKPGQAPRLLIYHT SRLHSGIPARFSGSGSGTDYTLTISSLQPEDFAVYFCQQGNTLPYTFGQGT KLEIKGGGGSGGGGSGGGGSQVQLQESGPGLVKPSETLSLTCTVSGVSLPD YGVSWIRQPPGKGLEWIGVIWGSETTYYSSSLKSRVTISKDNSKNQVSLKL SSVTAADTAVYYCAKHYYYGGSYAMDYWGQGTLVTVSS |
| 103101 CAR1 Soluble scFv - nt | 52 | Atggccctccctgtcaccgccctgctgcttccgctggctcttctgctccacgccgc tcggcccgaaattgtgatgacccagtcacccgccactcttagcctttcacccggtg agcgcgcaaccctgtcttgcagagcctcccaagacatctcaaaataccttaattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccggcggtggaggaagccaggtccaactccaagaaa gcggaccgggtcttgtgaagccatcagaaactctttcactgacttgtactgtgagc ggagtgtctctccccgattacggggtgtcttggatcagacagccaccggggaaggg tctggaatggattggagtgatttggggctctgagactacttactactcttcatccc tcaagtcacgcgtcaccatctcaaaggacaactctaagaatcaggtgtcactgaaa ctgtcatctgtgaccgcagccgacaccgccgtgtactattgcgctaagcattacta ttatggcgggagctacgcaatggattactggggacagggtactctggtcaccgtgt ccagccaccaccatcatccatcaccat |
| 103101 CAR1 Soluble scFv - aa | 64 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsqvqlqesgpglvkpsetlsltctvs gvslpdygvswirqppgkglewigviwgsettyyssslksrvtiskdnsknqvslk lssvtaadtavyycakhyyyggsyamdywgqgtlvtvsshhhhhhhh |
| 104875 CAR 1 - Full - nt | 90 | atggccctccctgtcaccgccctgctgcttccgctggctcttctgctccacgccgc tcggcccgaaattgtgatgacccagtcacccgccactcttagcctttcacccggtg agcgcgcaaccctgtcttgcagagcctcccaagacatctcaaaataccttaattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccggcggtggaggaagccaggtccaactccaagaaa gcggaccgggtcttgtgaagccatcagaaactctttcactgacttgtactgtgagc ggagtgtctctccccgattacggggtgtcttggatcagacagccaccggggaaggg tctggaatggattggagtgatttggggctctgagactacttactactcttcatccc tcaagtcacgcgtcaccatctcaaaggacaactctaagaatcaggtgtcactgaaa ctgtcatctgtgaccgcagccgacaccgccgtgtactattgcgctaagcattacta ttatggcgggagctacgcaatggattactggggacagggtactctggtcaccgtgt ccagccaccactaccccagcaccgaggccacccacccccggctcctaccatcgcctcc cagcctctgtccctgcgtccggaggcatgtagacccgcagctggtggggccgtgca tacccggggtcttgacttcgcctgcgatatctacatttgggcccctctggctggta cttgcggggtcctgctgctttcactcgtgatcactcttttactgtaagcgcggtcgg aagaagctgctgtacatctttaagcaaccccttcatgaggcctgtgcagactactca agaggaggacggctgttcatgccggttcccagaggaggaggaaggcggctgcgaac tgcgcgtgaaattcagccgcagcgcagatgctccagcctacaagcaggggcagaac cagctctacaacgaactcaatcttggtcggagagaggagtacgacgtgctggacaa gcggagaggacgggacccagaaatgggcgggaagccgcgcagaaagaatccccaag agggcctgtacaacgagctccaaaaggataagatggcagaagcctatagcgagatt ggtatgaaggggaacgcagaagaggcaaaggccacgacggactgtaccagggact cagcaccgccaccaaggacacctatgacgctcttcacatgcaggccctgccgcctc gg |
| 104875 CAR 1 - Full - aa | 77 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsqvqlqesgpglvkpsetlsltctvs gvslpdygvswirqppgkglewigviwgsettyyssslksrvtiskdnsknqvslk lssvtaadtavyycakhyyyggsyamdywgqgtlvtvsstttpaprpptpaptias qplslrpeacrpaaggavhtrgldfacdiyiwaplagtcgvlllslvitlyckrgr kkllyifkqpfmrpvqttqeedgcscrfpeeeeggcelrvkfsrsadapaykqgqn qlynelnlgrreeydvldkrrgrdpemggkprrknpqeglynelqkdkmaeaysei gmkgerrrgkghdglyqglstatkdtydalhmqalppr |
| CAR 2 | | |
| CAR2 scFv domain | 40 | Eivmtqspatlslspgeratlscrasqdiskylnwyqqkpgqaprlliyhtsrlhs giparfsgsgsgtdytltisslqpedfavyfcqqgntlpytfgqgtkleikggggs ggggsggggsqvqlqesgpglvkpsetlsltctvsgvslpdygvswirqppgkgle |

TABLE 4-continued

| | | CD19 CAR Constructs |
|---|---|---|
| Name | SEQ ID | Sequence |
| | | wigviwgsettyyqsslksrvtiskdnsknqvslklssvtaadtavyycakhyyyg<br>gsyamdywgqgtlvtvss |
| 103102<br>CAR2 -<br>Soluble<br>scFv - nt | 53 | Atggccctccctgtcaccgccctgctgcttccgctggctcttctgctccacgccgc<br>tcggcccgaaattgtgatgacccagtcacccgccactcttagcctttcaccggtg<br>agcgcgcaaccctgtcttgcagagcctcccaagacatctcaaaatacctttaattgg<br>tatcaacagaaagcccggacaggctcctcgccttctgatctaccacaccagccggct<br>ccattctggaatccctgccaggttcagcggtagcggatctgggaccgactacaccc<br>tcactatcagctcactgcagccagaggacttcgctgtctatttctgtcagcaaggg<br>aacacccctgccctacacctttggacagggcaccaagctcgagattaaaggtggagg<br>tggcagcggaggaggtgggtccggcggtggaggaagccaggtccaactccaagaa<br>gcggaccgggtcttgtgaagccatcagaaactctttcactgacttgtactgtgagc<br>ggagtgtctctcccccgattacggggtgtcttggatcagacagccaccggggaaggg<br>tctggaatggattggagtgatttggggctctgagactacttactaccaatcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagcaccaccatcatcaccat |
| 103102<br>CAR2 -<br>Soluble<br>scFv - aa | 65 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsqvqlqesgpglvkpsetlsltctvs<br>gvslpdygvswirqppgkglewigviwgsettyyqsslksrvtiskdnsknqvslk<br>lssvtaadtavyycakhyyyggsyamdywgqgtlvtvsshhhhhhhh |
| 104876<br>CAR 2 -<br>Full - nt | 91 | atggccctccctgtcaccgccctgctgcttccgctggctcttctgctccacgccgc<br>tcggcccgaaattgtgatgacccagtcacccgccactcttagcctttcaccggtg<br>agcgcgcaaccctgtcttgcagagcctcccaagacatctcaaaatacctttaattgg<br>tatcaacagaaagcccggacaggctcctcgccttctgatctaccacaccagccggct<br>ccattctggaatccctgccaggttcagcggtagcggatctgggaccgactacaccc<br>tcactatcagctcactgcagccagaggacttcgctgtctatttctgtcagcaaggg<br>aacacccctgccctacacctttggacagggcaccaagctcgagattaaaggtggagg<br>tggcagcggaggaggtgggtccggcggtggaggaagccaggtccaactccaagaa<br>gcggaccgggtcttgtgaagccatcagaaactctttcactgacttgtactgtgagc<br>ggagtgtctctcccccgattacggggtgtcttggatcagacagccaccggggaaggg<br>tctggaatggattggagtgatttggggctctgagactacttactaccaatcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagcaccactaccccagcaccgaggccacccacccggctcctaccatgcctcc<br>cagcctctgtccctgcgtccggaggcatgtagacccgcagctggtggggccgtgca<br>tacccggggtcttgacttcgcctgcgatatctacatttgggccctctggctggta<br>cttgcgggtcctgctgctttcactcgtgatcactcttttactgtaagcgcggtcgg<br>aagaagctgctgtacatctttaagcaaccctttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaac<br>cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaggggaacgcagaagaggcaaaggccacgacggactgtaccagggact<br>cagcaccgccaccaaggacacctatgacgctcttcacatgcaggccctgccgcctc<br>gg |
| 104876<br>CAR 2 -<br>Full - aa | 78 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsqvqlqesgpglvkpsetlsltctvs<br>gvslpdygvswirqppgkglewigviwgsettyyqsslksrvtiskdnsknqvslk<br>lssvtaadtavyycakhyyyggsyamdywgqgtlvtvsstttpaprpptpaptias<br>qplslrpeacrpaaggavhtrgldfacdiyiwaplagtcgvlllslvitlyckrgr<br>kkllyifkqpfmrpvqttqeedgcscrfpeeeeggcelrvkfsrsadapaykqgqn<br>qlynelnlgrreeydvldkrrgrdpemggkprrknpqeglynelqkdkmaeaysei<br>gmkgerrrgkghdglyqglstatkdtydalhmqalppr |
| | | CAR 3 |
| CAR3 scFv<br>domain | 41 | Qvqlqesgpglvkpsetlsltctvsgvslpdygvswirqppgkglewigviwgset<br>tyyssslksrvtiskdnsknqvslklssvtaadtavyycakhyyyggsyamdywgq<br>gtlvtvssggggsggggsggggseivmtqspatlslspgeratlscrasqdiskyl<br>nwyqqkpgqaprlliyhtsrlhsgiparfsgsgsgtdytltisslqpedfavyfcq<br>qgntlpytfgqgtkleik |
| 103104<br>CAR 3 -<br>Soluble<br>scFv - nt | 54 | Atggctctgccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactattcatcttccctgaagtcacgggtcaccatttcaaaggata |

TABLE 4-continued

CD19 CAR Constructs

| Name | SEQ ID | Sequence |
|---|---|---|
| | | actcaaagaatcaagtgagcctcaagctctcatcagtcaccgccgctgacaccgcc<br>gtgtattactgtgccaagcattactactatggagggtcctacgccatggactactg<br>gggccaggaactctggtcactgtgtcatctggtggaggaggtagcggaggaggcg<br>ggagcggtggaggtggctccgaaatcgtgatgacccagagccctgcaaccctgtcc<br>ctttctcccggggaacgggctaccctttcttgtcgggctcacaagatatctcaaa<br>atacctcaattggtatcaacagaagccgggacaggcccctaggcttcttatctacc<br>acacctctcgcctgcatagcgggattcccgcacgctttagcgggtctggaagcggg<br>accgactacactctgaccatctcatctctccagcccgaggacttcgccgtctactt<br>ctgccagcagggtaacaccctgccgtacaccttcggccagggcaccaagcttgaga<br>tcaaacatcaccaccatcatcaccatcac |
| 103104<br>CAR 3 -<br>Soluble<br>scFv - aa | 66 | MALPVTALLLPLALLLHAARPqvqlqesgpglvkpsetlsltctvsgvslpdygvs<br>wirqppgkglewigviwgsettyyssslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleikhhhhhhhh |
| 104877<br>CAR 3 -<br>Full - nt | 92 | atggctctgccctgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactattcatcttccctgaagtcacgggtcaccattcaaaggata<br>actcaaagaatcaagtgagcctcaagctctcatcagtcaccgccgctgacaccgcc<br>gtgtattactgtgccaagcattactactatggagggtcctacgccatggactactg<br>gggccaggaactctggtcactgtgtcatctggtggaggaggtagcggaggaggcg<br>ggagcggtggaggtggctccgaaatcgtgatgacccagagccctgcaaccctgtcc<br>ctttctcccggggaacgggctaccctttcttgtcgggcatcacaagatatctcaaa<br>atacctcaattggtatcaacagaagccgggacaggcccctaggcttcttatctacc<br>acacctctcgcctgcatagcgggattcccgcacgctttagcgggtctggaagcggg<br>accgactacactctgaccatctcatctctccagcccgaggacttcgccgtctactt<br>ctgccagcagggtaacaccctgccgtacaccttcggccagggcaccaagcttgaga<br>tcaaaaccactactcccgctccaaggccaccacccctgccccgaccatcgcctct<br>cagccgcttcctgcgtccggaggcatgtagacccgcagctggtggggccgtgca<br>tacccggggtcttgacttcgcctgcgatatctacatttgggccctctggctggta<br>cttgcgggtcctgctgctgcttcactcgtgatcactctttactgtaagcgcggtcgg<br>aagaagctgctgtacatctttaagcaaccttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaac<br>cagctctacaacgaactcaatcttggtcggagagaggagtacgacgtgctggacaa<br>gcggagaggacgggacccagaaatgggcgggaagccgcgcagaaagaatcccaag<br>agggcctgtacaacgagctccaaaaggataagatggcagaagcctatagcgagatt<br>ggtatgaaaggggaacgcagaagaggcaaaggccacgacggactgtaccagggact<br>cagcaccgccaccaaggacacctatgacgctcttcacatgcaggccctgccgcctc<br>gg |
| 104877<br>CAR 3 -<br>Full - aa | 79 | MALPVTALLLPLALLLHAARPqvqlqesgpglvkpsetlsltctvsgvslpdygvs<br>wirqppgkglewigviwgsettyyssslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleikttttpaprppptpaptias<br>qplslrpeacrpaaggavhtrgldfacdiyiwaplagtcgvlllslvitlyckrgr<br>kkllyifkqpfmrpvqttqeedgcscrfpeeeeggcelrvkfsrsadapaykqgqn<br>qlynelnlgrrreeydvldkrrgrdpemggkprrknpqeglynelqkdkmaeaysei<br>gmkgerrrgkghdglyqglstatkdtydalhmqalppr |
| | | CAR 4 |
| CAR4 scFv<br>domain | 42 | Qvqlqesgpglvkpsetlsltctvsgvslpdygvswirqppgkglewigviwgset<br>tyyqsslksrvtiskdnsknqvslklssvtaadtavyycakhyyyggsyamdywgq<br>gtlvtvssggggsggggsggggseivmtqspatlslspgeratlscrasqdiskyl<br>nwyqqkpgqaprlliyhtsrlhsgiparfsgsgsgtdytltisslqpedfavyfcq<br>qgntlpytfgqgtkleik |
| 103106<br>CAR4 -<br>Soluble<br>scFv - nt | 55 | Atggctctgcccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactattcatcttccctgaagtcacgggtcaccattcaaaggata<br>actcaaagaatcaagtgagcctcaagctctcatcagtcaccgccgctgacaccgcc<br>gtgtattactgtgccaagcattactactatggagggtcctacgccatggactactg<br>gggccaggaactctggtcactgtgtcatctggtggaggaggtagcggaggaggcg<br>ggagcggtggaggtggctccgaaatcgtgatgacccagagccctgcaaccctgtcc<br>ctttctcccggggaacgggctaccctttcttgtcgggcatcacaagatatctcaaa<br>atacctcaattggtatcaacagaagccgggacaggcccctaggcttcttatctacc<br>acacctctcgcctgcatagcgggattcccgcacgctttagcgggtctggaagcggg<br>accgactacactctgaccatctcatctctccagcccgaggacttcgccgtctactt |

TABLE 4-continued

CD19 CAR Constructs

| Name | SEQ ID | Sequence |
|---|---|---|
| | | ctgccagcagggtaacaccctgccgtacaccttcggccagggcaccaagcttgaga<br>tcaaacatcaccaccatcatcaccatcac |
| 103106<br>CAR4 -<br>Soluble<br>scFv - aa | 67 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleikhhhhhhhh |
| 104878<br>CAR 4 -<br>Full - nt | 93 | atggctctgcccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaacccacttactataatcttccctgaagtcacgggtcaccattcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaaactctggtcactgtgtcatctggtggaggaggtagcggaggaggcg<br>gagcggtggaggtggctccgaaatcgtgatgacccagagccctgcaaccctgtcc<br>ctttctcccggggaacgggctaccctttcttgtcggcatcacaagatatctcaaa<br>atacctcaattggtatcaacagaagccgggacaggcccctaggcttcttatctacc<br>acacctctcgcctgcatagcgggattcccgcacgctttagcgggtctggaagcggg<br>accgactacactctgaccatctcatctccagcccgaggacttcgccgtctactt<br>ctgccagcagggtaacaccctgccgtacaccttcggccagggcaccaagcttgaga<br>tcaaaccactactcccgctccaaggccaccacccctgccccgaccatcgcctct<br>cagccgctttccctgcgtccggaggcatgtagacccgcagctggtggggccgtgca<br>tacccggggtcttgacttcgcctgcgatatctacatttgggccctctggctggta<br>cttgcgggtcctgctgctttcactcgtgatcactctttactgtaagcgcggtcgg<br>aagaagctgctgtacatctttaagcaaccccttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcagggcagaac<br>cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaggggaacgcagaagaggcaaaggccacgacggactgtaccagggact<br>cagcaccgccaccaaggacacctatgacgctcttcacatgcaggccctgccgcctc<br>gg |
| 104878<br>CAR 4 -<br>Full - aa | 80 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleiktttpaprppptpaptias<br>qplslrpeacrpaaggavhtrgldfacdiyiwaplagtcgvlllslvitlyckrgr<br>kkllyifkqpfmrpvqttqeedgcscrfpeeeeggcelrvkfsrsadapaykqgqn<br>qlynelnlgrreeydvldkrrgrdpemggkprrknpqeglynelqkdkmaeaysei<br>gmkgerrrgkghdglyqglstatkdtydalhmqalppr |

CAR 5

| | | |
|---|---|---|
| CAR5 scFv<br>domain | 43 | Eivmtqspatlslspgeratlscrasqdiskylnwyqqkpgqaprlliyhtsrlhs<br>giparfsgsgsgtdytltisslqpedfavyfcqqgntlpytfgqgtkleikggggs<br>ggggsggggsggggsqvqlqesgpglvkpsetlsltctvsgvslpdygvswirqpp<br>gkglewigviwgsettyyssslksrvtiskdnsknqvslklssvtaadtavyycak<br>hyyyggsyamdywgqgtlvtvss |
| 99789<br>CAR5 -<br>Soluble<br>scFv - nt | 56 | atggccctcccagtgaccgctctgctgctgcctctcgcacttcttctccatgccgc<br>tcggcctgagatcgtcatgacccaaagcccgctaccctgtccctgtcacccggcg<br>agagggcaaccctttcatgcagggccagccaggacatttctaagtacctcaactgg<br>tatcagcagaagccagggcaggctcctcgcctgctgatctaccacaccagccgct<br>ccacagcggtatccccgccagattttccgggagcgggtctggaaccgactacaccc<br>tcaccatctcttctctgcagcccgaggatttcgccgtctatttctgccagcagggg<br>aatactctgccgtacaccttcggtcaaggtaccaagctggaaatcaagggaggcgg<br>aggatcaggcggtggcggaagcggaggaggtggctccggaggaggaggttcccaag<br>tgcagcttcaagaatcaggacccggacttgtgaagccatcagaaaccctctccctg<br>acttgtaccgtgtccggtgtgagcctccccgactacggagtctcttggattcgcca<br>gcctccggggaagggtcttgaatggattgggtgatttgggatcagagactactt<br>actactcttcatcacttaagtcacgggtcaccatcagcaaagataatagcaagaac<br>caagtgtcacttaagctgtcatctgtgaccgccgctgacaccgccgtgtactattg<br>tgccaaacattactattacggagggtcttatgctatggactactggggacagggga<br>ccctggtgactgtctctagccatcaccatcaccaccatcatcac |
| 99789<br>CAR5 -<br>Soluble<br>scFv - aa | 68 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsggggsqvqlqesgpglvkpsetlsl<br>tctvsgvslpdygvswirqppgkglewigviwgsettyyssslksrvtiskdnskn<br>qvslklssvtaadtavyycakhyyyggsyamdywgqgtlvtvsshhhhhhhh |

TABLE 4-continued

| CD19 CAR Constructs | | |
|---|---|---|
| Name | SEQ ID | Sequence |
| 104879 CAR 5 - Full - nt | 94 | atggccctccctgtcaccgccctgctgcttccgctggctcttctgctccacgccgc tcggcccgaaattgtgatgacccagtcacccgccactcttagcctttcacccggtg agcgcgcaaccctgtcttgcagagcctcccaagacatctcaaaatacct taattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacaccctttggacagggcaccaagctcgagattaaaggtggagg tggcagcggaggaggtgggtccggcggtggaggaagcggcggaggcgggagccagg tccaactccaagaaagcggacccgggtcttgtgaagccatcagaaactctttcactg acttgtactgtgagcggagtgtctctccccgattacggggtgtcttggatcagaca gccaccggggaagggtctggaatggattggagtgatttgggcctctgagactactt actactcttcatccctcaagtcacgcgtcaccatctcaaaggacaactctaagaat caggtgtcactgaaactgtcatctgtgaccgcagccgacaccgccgtgtactattg cgctaagcattactattatggcgggagctacgcaatggattactggggacagggta ctctggtcaccgtgtccagcaccactaccccagcaccgaggccacccacccccggct cctaccatcgcctcccagctctgtcctgcgtccggaggcatgtagacccgcagc tggtggggccgtgcatacccggggtcttgacttcgcctgcgatatctacatttggg ccccttctggctggtacttgcggggtcctgctgctttcactcgtgatcactctttac tgtaagcgcggtcggaagaagctgctgtacatcttcaagcaaccttcatgaggcc tgtgcagactactcaagaggaggacggctgttcatgccggttcccagaggaggagg aaggcggctgcgaactgcgcgtgaaattcagccgcagcgcagatgctccagcctac aagcaggggcagaaccagctctacaacgaactcaatcttggtcggagagaggagta cgacgtgctggacaagcggagaggacgggacccagaaatgggcgggaagccgcgca gaaagaatcccaagagggcctgtacaacgagctccaaaaggataagatggcagaa gcctatagcgagattggtatgaaaggggaacgcagaagaggcaaaggccacgacgg actgtaccagggactcagcaccgccaccaaggacacctatgacgctcttcacatgc aggccctgccgcctcgg |
| 104879 CAR 5 - Full - aa | 81 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsggggsqvqlqesgpglvkpsetlsl tctvsgvslpdygvswirqppgkglewigviwgsettyysssIksrvtiskdnskn qvslklssvtaadtavyycakhyyyggsyamdywgqgtlvtvsstttpaprpptpa ptiasqplslrpeacrpaaggavhtrgldfacdiyiwaplagtcgvlllslvitly ckrgrkkllyifkqpfmrpvqttqeedgcscrfpeeeeggcelrvkfsrsadapay kqgqnqlynelnlgrreeydvldkrrgrdpemggkprrknpqeglynelqkdkmae ayseigmkgerrrgkghdglyqglstatkdtydalhmqalppr |
| CAR 6 | | |
| CAR6 scFv domain | 44 | Eivmtqspatlslspgeratlscrasqdiskylnwyqqkpgqaprlliyhtsrlhs giparfsgsgsgtdytltisslqpedfavyfcqqgntlpytfgqgtkleikggggs ggggsggggsggggsqvqlqesgpglvkpsetlsltctvsgvslpdygvswirqpp gkglewigviwgsettyyqslksrvtiskdnsknqvslklssvtaadtavyycak hyyyggsyamdywgqgtlvtvss |
| 99790 CAR6 - Soluble scFv - nt | 57 | atggccctcccagtgaccgctctgctgctgcctctcgcacttcttctccatgccgc tcggcctgagatcgtcatgacccaaagccccgctaccctgtccctgtcacccggcg agagggcaaccctttcatgcagggccagccaggacatttctaagtacctcaactgg tatcagcagaagcagggcaggctcctcgcctgctgatctaccacaccagccggct ccacagcggtatccccgccagatttccgggagcgggtctggaaccgactacaccc tcaccatctcttctctgcagcccgaggatttcgccgtctatttctgccagcaggg aatactctgccgtacaccttcggtcaaggtaccaagctggaaatcaagggaggcgg aggatcaggcggtggcggaagcggaggaggtggctccggaggaggaggttccaag tgcagcttcaagaatcaggacccggacttgtgaagccatcagaaacctctccctg acttgtaccgtgtccggtgtgagcctccccgactacggagtctcttggattcgcca gcctccggggaagggtcttgaatggattgggtgatttgggatcagagactactt actaccagtcatcacttaagtcacgggtcaccatcagcaaagataatagcaagaac caagtgtcacttaagctgtcatctgtgaccgccgctgacaccgccgtgtactattg tgccaaacattactattacggagggtcttatgctatggactactggggacagggga ccctggtgactgtctctagccatcaccatcaccaccatcatcac |
| 99790 CAR6 - Soluble scFv - aa | 69 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsggggsqvqlqesgpglvkpsetlsl tctvsgvslpdygvswirqppgkglewigviwgsettyyqslksrvtiskdnskn qvslklssvtaadtavyycakhyyyggsyamdywgqgtlvtvsshhhhhhhh |
| 104880 CAR6 - Full - nt | 95 | atggccctccctgtcaccgccctgctgcttccgctggctcttctgctccacgccgc tcggcccgaaattgtgatgacccagtcacccgccactcttagcctttcacccggtg agcgcgcaaccctgtcttgcagagcctcccaagacatctcaaaatacct taattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacaccctttggacagggcaccaagctcgagattaaaggtggagg |

TABLE 4-continued

CD19 CAR Constructs

| Name | SEQ ID | Sequence |
|---|---|---|
| | | tggcagcggaggaggtgggtccggcggtggaggaagcggaggcggagggagccagg<br>tccaactccaagaaagcggacccgggtcttgtgaagccatcagaaactctttcactg<br>acttgtactgtgagcggagtgtctctccccgattacggggtgtcttggatcagaca<br>gccaccggggaagggtctggaatggattggagtgatttggggctctgagactactt<br>actaccaatcatccctcaagtcacgcgtcaccatctcaaaggacaactctaagaat<br>caggtgtcactgaaactgtcatctgtgaccgcagccgacaccgccgtgtactattg<br>cgctaagcattactattatggcgggagctacgcaatggattactggggacagggta<br>ctctggtcaccgtgtccagcaccactaccccagcaccgaggccacccaccccggct<br>cctaccatcgcctcccagctctgtccctgcgtccggaggcatgtagacccgcagc<br>tggtggggccgtgcatacccggggtcttgacttcgcctgcgatatctacatttggg<br>cccctctggctggtacttgcggggtcctgctgctttcactcgtgatcactctttac<br>tgtaagcgcggtcggaagaagctgctgtacatcttaagcaaccttcatgaggcc<br>tgtgcagactactcaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 104880<br>CAR6 -<br>Full - aa | 82 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikgggsgggsgggsgggsqvqlqesgpglvkpsetlsl<br>tctvsgvslpdygvswirqppgkglewigviwgsettyygsslksrvtiskdnskn<br>qvslklssvtaadtavyycakhyyyggsyamdywgqgtlvtvssttttpaprpptpa<br>ptiasqplslrpeacrpaaggavhtrgldfacdiyiwaplagtcgvlllslvitly<br>ckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |

CAR 7

| CAR7 scFv<br>domain | 45 | Qvqlqesgpglvkpsetlsltctvsgvslpdygvswirqppgkglewigviwgset<br>tyyssslksrvtiskdnsknqvslklssvtaadtavyycakhyyyggsyamdywgq<br>gtlvtvssggggsggggsggggsggggseivmtqspatlslspgeratlscrasqd<br>iskylnwyqqkpgqaprlliyhtsrlhsgiparfsgsgsgtdytltisslqpedfa<br>vyfcqqgntlpytfgqgtkleik |
| 100796<br>CAR7 -<br>Soluble<br>scFv - nt | 58 | atggcactgcctgtcactgccctcctgctgcctctggcccttcctctgcatgccgc<br>caggcccccaagtccagctgcaagagtcaggaccccggactggtgaagccgtctgaga<br>ctctctcactgacttgtaccgtcagcgcgtcgtccctccccgactacggagtgtca<br>tggatccgccaacctcccgggaaagggcttgaatggattggtgtcatctgggggttc<br>tgaaaccacctactactcatcttccctgaagtcagggtgaccatcagcaaggata<br>attccaagaaccaggtcagccttaagctgtcatctgtgaccgctgctgacaccgcc<br>gtgtattactgcgccaagcactactattacggaggaagctacgctatggactattg<br>gggacagggcactctcgtgactgtgagcagcggcggtggaggtctggaggtggag<br>gatccggtggtggtgggtcaggcggaggagggagcgagattgtgatgactcagtca<br>ccagccacccttctcttcacccggcgagagagcaaccctgagctgtagcag<br>ccaggacatttctaagtacctcaactggtatcagcaaaaaccggggcaggcccctc<br>gcctcctgatctaccataccctcacgccttcactctggtatccccgctcggtttagc<br>ggatcaggatctggtaccgactacactctgaccatttccagcctgcagccagaaga<br>tttcgcagtgtatttctgccagcagggcaataccctcttacaccttcggtcagg<br>gaaccaagctcgaaatcaagcaccatcaccatcatcaccat |
| 100796<br>CAR7 -<br>Soluble<br>scFv - aa | 70 | MALPVTALLLPLALLLHAARPqvqlqesgpglvkpsetlsltctvsgvslpdygvs<br>wirqppgkglewigviwgsettyyssslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleikhhhhhhhh |
| 104881<br>CAR 7<br>Full - nt | 96 | atggctctgccgtgaccgcactcctcctgccactggctctgctgcttcacgccgc<br>tcgcccacaagtccagctcaagaatcagggcctggtctggtgaagccatcagagt<br>ctctgtccctcacttgcaccgtgagcggagtgtccctcccagactacggagtgagc<br>tggattagacagcctcccgggaaaggagactggagtggatcggagtgatttggggtag<br>cgaaaccacttactattcatcttccctgaagtcacgggtcaccattcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>ggagcggtggaggtggctccggaggtggcggaagcgaaatcgtgatgacccagagc<br>cctgcaaccctgtcccttctcccggggaacggtaccccttcttgtcggcatc<br>acaagatatctcaaaatacctcaattggtatcaacagaagccgggacaggcccta<br>ggcttcttatctaccacacctctcgcctgcatagcgggattcccgcacgctttagc<br>gggtctggaagcgggaccgactacactctgaccatctcatctccagcccgagga<br>cttcgccgtctacttctgccagcagggtaacaccctgccgtacaccttcggccagg<br>gcaccaagcttgagatcaaaaccactactcccgctccaaggccacccaccccctgcc |

TABLE 4-continued

CD19 CAR Constructs

| Name | SEQ ID | Sequence |
|---|---|---|
| | | ccgaccatcgcctctcagccgctttccctgcgtccggaggcatgtagacccgcagc<br>tggtggggccgtgcatacccggggtcttgacttcgcctgcgatatctacatttggg<br>cccctctggctggtacttgcggggtcctgctgctttcactcgtgatcactctttac<br>tgtaagcgcggtcggaagaagctgctgtacatctttaagcaaccctttcatgaggcc<br>tgtgcagactactcaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatcccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 104881<br>CAR 7<br>Full - aa | 83 | MALPVTALLLPLALLLHAARPqvqlqesgpglvkpsetlsltctvsgvslpdygvs<br>wirqppgkglewigviwgsettyyssslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleiktttpaprpptpa<br>ptiasqplslrpeacrpaaggavhtrgldfacdiyiwaplagtcgvlllslvitly<br>ckrgrkkllyifkqpfmrpvqttqeedgcscrfpeeeeggcelrvkfsrsadapay<br>kqgqnqlynelnlgrreeydvldkrrgrdpemggkpprrknpqeglynelqkdkmae<br>ayseigmkgerrrgkghdglyqglstatkdtydalhmqalppr |

CAR 8

| CAR8 scFv<br>domain | 46 | Qvqlqesgpglvkpsetlsltctvsgvslpdygvswirqppgkglewigviwgset<br>tyyqsslksrvtiskdnsknqvslklssvtaadtavyycakhyyyggsyamdywgq<br>gtlvtvssggggsggggsggggsggggseivmtqspatlslspgeratlscrasqd<br>iskylnwyqqkpgqaprlliyhtsrlhsgiparfsgsgsgtdytltisslqpedfa<br>vyfcqqgntlpytfgqgtkleik |
| 100798<br>CAR8 -<br>Soluble<br>scFv - nt | 59 | atggcactgcctgtcactgccctcctgctgcctctggcctccttctgcatgccgc<br>caggcccaagtccagctgcaagagtcaggaccggactggtgaagccgtctgaga<br>ctctctcactgacttgtaccgtcagcggcgtgtccctccccgactacggagtgtca<br>tggatccgccaacctcccgggaaagggcttgaatggattggtgtcatctgggttc<br>tgaaaccacctactaccagtcttccctgaagtcagggtgaccatcagcaaggata<br>attccaagaaccaggtcagccttaagctgtcatctgtgaccgctgctgacaccgcc<br>gtgtattactgcgccaagcactactattacggaggaagctacgctatggactattg<br>gggacagggcactctcgtgactgtgagcagcggcggtggaggtctggaggtggag<br>gatccggtggtggtgggtcaggcggaggagggagcgagattgtgatgactcagtca<br>ccagccacccttctcttcaccggcgagagagcaaccctgagctgtagagcag<br>ccaggacatttctaagtacctcaactggtatcagcaaaaaccggggcaggcccctc<br>gcctcctgatctaccatacctcacgccttcactctggtatccccgctcggtttagc<br>ggatcaggatctggtaccgactacactctgaccatttccagcctgcagccagaaga<br>tttcgcagtgtatttctgccagcagggcaataccctccttacaccttcggtcagg<br>gaaccaagctcgaaatcaagcaccatcaccatcatcatcaccac |
| 100798<br>CAR8 -<br>Soluble<br>scFv - aa | 71 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleikhhhhhhhh |
| 104882<br>CAR 8 -<br>Full - nt | 97 | atggctctgccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactatcaatcttccctgaagtcacgggtcaccatttcaaaggata<br>actcaaagaatcaagtgagcctcaagctctcatcagtcaccgccgctgacaccgcc<br>gtgtattactgtgccaagcattactactatggagggtcctacgccatgactactg<br>gggccaggaactctggtcactgtgtcatctggtggaggaggtagcggaggaggcg<br>ggagcggtggaggtggctccgaggcggtgggtcagaaatcgtgatgacccagagc<br>cctgcaaccctgtcccttctcccggggaacgggctaccccttcttgtcgggcatc<br>acaagatatctcaaaatacctcaattggtatcaacagaagccgggacaggcccccta<br>ggcttcttatctaccacacctctcgcctgcatagcgggattcccgcacgctttagc<br>gggtctggaagcgggaccgactacactctgaccatctcatctctccagcccgagga<br>cttcgccgtctacttctgccagcagggtaacaccctgccgtacacccttcggccagg<br>gcaccaagcttgagatcaaaaccactactcccgctccaaggcacccaccccctgcc<br>ccgaccatcgcctctcagccgctttccctgcgtccggaggcatgtagacccgcagc<br>tggtggggccgtgcatacccggggtcttgacttcgcctgcgatatctacatttggg<br>cccctctggctggtacttgcggggtcctgctgctttcactcgtgatcactctttac<br>tgtaagcgcggtcggaagaagctgctgtacatctttaagcaaccctttcatgaggcc<br>tgtgcagactactcaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca |

TABLE 4-continued

| | | CD19 CAR Constructs |
|---|---|---|
| Name | SEQ ID | Sequence |
| | | gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 104882<br>CAR 8 -<br>Full - aa | 84 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleiktttpaprpptpa<br>ptiasqplslrpeacrpaaggavhtrgldfacdiyiwaplagtcgvlllslvitly<br>ckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |
| | | CAR 9 |
| CAR9 scFv<br>domain | 47 | Eivmtqspatlslspgeratlscrasqdiskylnwyqqkpgqaprlliyhtsrlhs<br>giparfsgsgsgtdytltisslqpedfavyfcqqgntlpytfgqgtkleikggggs<br>ggggsggggsggggsqvqlqesgpglvkpsetlsltctvsgvslpdygvswirqpp<br>gkglewigviwgsettyynsslksrvtiskdnsknqvslklssvtaadtavyycak<br>hyyyggsyamdywgqgtlvtvss |
| 99789<br>CAR9 -<br>Soluble<br>scFv - nt | 60 | atggccctcccagtgaccgctctgctgctgcctctcgcacttcttctccatgccgc<br>tcggcctgagatcgtcatgacccaaagcccccgctaccctgtccctgtcaccggcg<br>agagggcaaccctttcatgcagggccagccaggacatttctaagtacctcaactgg<br>tatcagcagaaagccagggcaggctcctcgcctgctgatctaccacaccagccgct<br>ccacagcggtatccccgccagattttcggggagcgggtctggaaccgactacaccc<br>tcaccatctcttctctgcagcccgaggatttcgccgtctatttctgccagcagggg<br>aatactctgccgtacaccttcggtcaaggtaccaagctggaaatcaagggaggcgg<br>aggatcaggcggtggcggaagcggaggaggtggctccggaggaggaggttcccaag<br>tgcagcttcaagaatcaggacccggacttgtgaagccatcagaaacctctccctg<br>acttgtaccgtgtccggtgtgagcctccccgactacggagtctcttggattcgcca<br>gcctccggggaagggtcttgaatggattgggtgatttgggatcagagactactt<br>actacaattcatcacttaagtcacgggtcaccatcagcaaagataatagcaagaac<br>caagtgtcacttaagctgtcatctgtgaccgccgctgacaccgccgtgtactattg<br>tgccaaacattactattacggagggtcttatgctatggactactggggacaggga<br>ccctggtgactgtctctagccatcaccatcaccaccatcatcac |
| 99789<br>CAR9 -<br>Soluble<br>scFv - aa | 72 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsggggsqvqlqesgpglvkpsetlsl<br>tctvsgvslpdygvswirqppgkglewigviwgsettyynsslksrvtiskdnskn<br>qvslklssvtaadtavyycakhyyyggsyamdywgqgtlvtvsshhhhhhhh |
| 105974<br>CAR 9 -<br>Full - nt | 98 | atggccctccctgtcaccgccctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaaataccttaattgg<br>tatcaacagaagcccggacaggctcctcgccttctgatctaccacaccagccggct<br>ccattctggaatccctgccaggttcagcggtagcggatctgggaccgactacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagcggaggcggtgggagccagg<br>tccaactccaagaaagcggaccgggtcttgtgaagccatcagaaactctttcactg<br>acttgtactgtgagcggagtgtctctccccgattacggggtgtcttggatcagaca<br>gccaccggggaaggtctggaatggattggagtgatttgggctctgagactactt<br>actacaactcatccctcaagtcacgcgtcaccatctcaaaggacaactctaagaat<br>caggtgtcactgaaactgtcatctgtgaccgcagccgacaccgccgtgtactattg<br>cgctaagcattactattatggcgggagctacgcaatggattactggggacaggta<br>ctctggtcaccgtgtccagcaccactaccccagcaccgaggccacccaccccggct<br>cctaccatcgcctcccagcctctgtccctgcgtccggaggcatgtagacccgcagc<br>tggtggggccgtgcatacccggggtcttgacttcgcctgcgatatctacatttggg<br>cccctctggctggtacttgcgggtcctgctgctttcactcgtgatcactctttac<br>tgtaagcgcggtcggaagaagctgctgtacatcttaagcaaccctcatgaggcc<br>tgtgcagactactcaagaggaggacggctgttcatgccggttcccagaggaggagg<br>aaggcggctgcgaactgcgcgtgaaattcagccgcagcgcagatgctccagcctac<br>aagcagggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |

TABLE 4-continued

CD19 CAR Constructs

| Name | SEQ ID | Sequence |
|---|---|---|
| 105974 CAR 9 - Full - aa | 85 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsggggsqvqlqesgpglvkpsetlsl tctvsgvslpdygvswirqppgkglewigviwgsettyynsslksrvtiskdnskn qvslklssvtaadtavyycakhyyyggsyamdywgqgtlvtvssttpaprpptpa ptiasqplslrpeacrpaaggavhtrgldfacdiyiwaplagtcgvlllslvitly ckrgrkkllyifkqpfmrpvqttqeedgcscrfpeeeeggcelrvkfsrsadapay kqgqnqlynelnlgrreeydvldkrrgrdpemggkprrknpqeglynelqkdkmae ayseigmkgerrrgkghdglyqglstatkdtydalhmqalppr |

CAR10

| | | |
|---|---|---|
| CAR10 scFv domain | 48 | Qvqlqesgpglvkpsetlsltctvsgvslpdygvswirqppgkglewigviwgset tyynsslksrvtiskdnsknqvslklssvtaadtavyycakhyyyggsyamdywgq gtlvtvssggggsggggsggggsggggseivmtqspatlslspgeratlscrasqd iskylnwyqqkpgqaprlliyhtsrlhsgiparfsgsgsgtdytltisslqpedfa vyfcqqgntlpytfgqgtkleik |
| 100796 CAR10 - Soluble scFv - nt | 61 | atggcactgcctgtcactgccctcctgctgcctctggccctccttctgcatgccgc caggcccaagtccagctgcaagagtcaggacccggactggtgaagcctctgaga ctctctcactgacttgtaccgtcagcggcgtgtccctccccgactacggagtgtca tggatccgccaacctcccgggaaagggcttgaatggattggtgtcatctggggttc tgaaacccactactacaactcttccctgaagtccaggggtgaccatcagcaaggata attccaagaacaggtcagccttaagctgtcatctgtgaccgctgctgacaccgcc gtgtattactgcgccaagcactactattacggaggaagctacgctatgactattg gggacagggcactctcgtgactgtgagcagcggcggtggagggtctggaggtggag gatccggtggtggtgggtcaggcggaggagggagcgagattgtgatgactcagtca ccagccaccttctctttcaccggcgagagagcaaccctgagctgtagagcag ccaggacatttctaagtacctcaactggtatcagcaaaaaccggggcaggcccctc gcctcctgatctaccatacctcacgccttcactctggtatccccgctcggtttagc ggatcaggatctggtaccgactacactctgaccatttccagcctgcagccagaaga tttcgcagtgtatttctgccagcagggcaataccttccttacaccttcggtcagg gaaccaagctcgaaatcaagcaccatcaccatcatcaccaccat |
| 100796 CAR10 - Soluble scFv - aa | 73 | MALPVTALLLPLALLLHAARPqvqlqesgpglvkpsetlsltctvsgvslpdygvs wirqppgkglewigviwgsettyynsslksrvtiskdnsknqvslklssvtaadta vyycakhyyyggsyamdywgqgtlvtvssggggsggggsggggsggggseivmtqs patlslspgeratlscrasqdiskylnwyqqkpgqaprlliyhtsrlhsgiparfs gsgsgtdytltisslqpedfavyfcqqgntlpytfgqgtkleikhhhhhhhh |
| 105975 CAR 10 Full - nt | 99 | atggccctccctgtcaccgccctgctgcttccgctggctcttctgctccacgccgc tcggcccgaaattgtgatgacccagtcacccgccactcttagcctttcaccggtg agcgcgcaaccctgtcttgcagagcctcccaagacatctcaaaataccttaattgg tatcaacagaaacccggacaggctcctcgccttctgatctaccacaccagccggct ccattctgaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccgcggtggaggaagcggaggcggtgggagccagg tccaactccaagaaaggaccgggtcttgtgaagcatcagaaactctttcactg acttgtactgtgagcggagtgtctctccccgattacggggtgtcttggatcagaca gccaccggggaagggtctggaatggattggagtgatttgggctctgagactactt actacaactcatccctcaagtcacgcgtcaccatctcaaaggacaactctaagaat caggtgtcactgaaactgtcatctgtgaccgcagccgacaccgccgtgtactattg cgctaagcattactattatggcgggagctacgcaatgattactgggacaggta ctctggtcaccgtgtccagcaccactacccagcaccgaggccacccaccccggct cctaccatcgcctcccagcctctgtccctgcgtccggaggcatgtagacccgcagc tggtggggccgtgcataccgggggtcttgacttcgcctgcgatatctacatttggg cccctctggctggtacttgcggggtcctgctgctttcactcgtgatcactctttac tgtaagcgcggtcggaagaagctgctgtacatcttaagcaaccttcatgaggcc tgtgcagactactcaagaggaggacggcgttcatgccggttcccagaggaggagg aaggcggctgcgaactgcgcgtgaaattcagccgcagcgcagatgctccagcctac aagcagggcagaaccagctctacaacgaactcaatcttggtcggagagaggagta cgacgtgctggacaagcgagaggacgggacccagaaatgggcgggaagccgcgca gaaagaatcccaagagggcctgtacaacgagctccaaaaggataagatggcagaa gcctatagcgagattggtatgaagggaacgcagaagaggcaaaggccacgacgg actgtaccagggactcagcaccgccaccaaggacacctatgacgctcttcacatgc aggccctgccgcctcgg |
| 105975 CAR 10 Full - aa | 86 | MALPVTALLLPLALLLHAARPEIVMTQSPATLSLSPGERATLSCRASQDISKYLNW YQQKPGQAPRLLIYHTSRLHSGIPARFSGSGSGTDYTLTISSLQPEDFAVYFCQQG NTLPYTFGQGTKLEIKGGGGSGGGGSGGGGSGGGGSQVQLQESGPGLVKPSETLSL TCTVSGVSLDYGVSWIRQPPGKGLEWIGVIWGSETTYYNSSLKSRVTISKDNSKN QVSLKLSSVTAADTAVYYCAKHYYYGGSYAMDYWGQGTLVTVSSTTTPAPRPPTPA PTIASQPLSLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFSRSADAPAY |

TABLE 4-continued

CD19 CAR Constructs

| Name | SEQ ID | Sequence |
|---|---|---|
| | | KQGQNQLYNELNLGRREEYDVLDKRRGRDPEMGGKPRRKNPQEGLYNELQKDKMAE<br>AYSEIGMKGERRRGKHDGLYQGLSTATKDTYDALHMQALPPR |

CAR11

| Name | SEQ ID | Sequence |
|---|---|---|
| CAR11<br>scFv<br>domain | 49 | Eivmtqspatlslspgeratlscrasqdiskylnwyqqkpgqaprlliyhtsrlhs<br>giparfsgsgsgtdytltisslqpedfavyfcqqgntlpytfgqgtkleikggggs<br>ggggsggggsqvqlqesgpglvkpsetlsltctvsgvslpdygvswirqppgkgle<br>wigviwgsettyynsslksrvtiskdnsknqvslklssvtaadtavyycakhyyyg<br>gsyamdywgqgtlvtvss |
| 103101<br>CAR11 -<br>Soluble<br>scFv - nt | 62 | Atggccctcctgtcaccgccctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaaatacctt aattgg<br>tatcaacagaaagcccggacaggctcctcgcctttctgatctaccacaccagccgct<br>ccattctggaatccctgccaggttcagcggtagcggatctgggaccgactacaccc<br>tcactatcagctcactgcagccagaggacttcgctgtctatttctgtcagcaaggg<br>aacaccctgccctacaccttt ggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttggggctctgagactacttactacaattcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagccaccaccatcatcaccatcaccat |
| 103101<br>CAR11 -<br>Soluble<br>scFv - aa | 74 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsqvqlqesgpglvkpsetlsltctvs<br>gvslpdygvswirqppgkglewigviwgsettyynsslksrvtiskdnsknqvslk<br>lssvtaadtavyycakhyyyggsyamdywgqgtlvtvsshhhhhhhh |
| 105976<br>CAR 11<br>Full - nt | 100 | atggctctgcccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttgggggtag<br>cgaaaccacttactataactcttccctgaagtcacgggtcaccatttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>gaggcggtggaggtggctccggaggtggcggaagcgaaatcgtgatgacccagagc<br>cctgcaaccctgtccctttctcccggggaacgggctaccctttcttgtcgggcatc<br>acaagatatctcaaaatacctcaattggtatcaacagaagccgggacaggcccct a<br>ggcttcttatctaccacacctctcgcctgcatagcgggattcccgcacgctttagc<br>gggtctggaagcgggaccgactacactctgaccatctcatctctccagcccgagga<br>cttcgccgtctacttctgccagcagggtaacaccctgccgtacaccttcggccagg<br>gcaccaagcttgagatcaaaaccactactcccgctccaaggccacccacccctgcc<br>ccgaccatcgcctctcagccgctttcctgcgtccggaggcatgtagacccgcagc<br>tggtggggccgtgcataccccggggtcttgacttcgcctgcgatatctacatttggg<br>ccctctggctggtacttgcggggtcctgctgctttcactcgtgatcactctttac<br>tgtaagcgcggtcggaagaagctgctgtacatctttaagcaaccctt catgaggcc<br>tgtgcagactactcaagaggaggacggctgttcatgccggttcccagaggaggagg<br>aaggcggctgcgaactgcgcgtgaaattcagccgcagccagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaggggaacgcagaagaggcaaaggccacgacgg<br>actgtaccagggactcagcaccgccaccaaggacacctatgacgctcttcacatgc<br>aggccctgccgcctcgg |
| 105976<br>CAR 11<br>Full - aa | 87 | MALPVTALLLPLALLLHAARPQVQLQESGPGLVKPSETLSLTCTVSGVSLPDYGVS<br>WIRQPPGKGLEWIGVIWGSETTYYNSSLKSRVTISKDNSKNQVSLKLSSVTAADTA<br>VYYCAKHYYYGGSYAMDYWGQGTLVTVSSGGGGSGGGGSGGGGSGGGGSEIVMTQS<br>PATLSLSPGERATLSCRASQDISKYLNWYQQKPGQAPRLLIYHTSRLHSGIPARFS<br>GSGSGTDYTLTISSLQPEDFAVYFCQQGNTLPYTFGQGTKLEIKTTTPAPRPPTPA<br>PTIASQPLSLRPEACRPAAGGAVHTRGLDFACDIYIWAPLAGTCGVLLLSLVITLY<br>CKRGRKKLLYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNELQKDKMAE<br>AYSEIGMKGERRRGKHDGLYQGLSTATKDTYDALHMQALPPR |

CAR12

| Name | SEQ ID | Sequence |
|---|---|---|
| CAR12<br>scFv<br>domain | 50 | Qvqlqesgpglvkpsetlsltctvsgvslpdygvswirqppgkglewigviwgset<br>tyynsslksrvtiskdnsknqvslklssvtaadtavyycakhyyyggsyamdywgq<br>gtlvtvssggggsggggsggggseivmtqspatlslspgeratlscrasqdiskyl |

TABLE 4-continued

CD19 CAR Constructs

| Name | SEQ ID | Sequence |
|---|---|---|
| | | nwyqqkpgqaprlliyhtsrlhsgiparfsgsgsgtdytltisslqpedfavyfcq<br>qgntlpytfgqgtkleik |
| 103104<br>CAR12 -<br>Soluble<br>scFv - nt | 63 | Atggctctgcccgtgaccgcactcctcctgccactggctctgctgcttcacgccgc<br>tcgcccacaagtccagcttcaagaatcagggcctggtctgtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactataactcttccctgaagtcacgggtcaccatttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>ggagcggtggaggtggctccgaaatcgtgatgacccagagccctgcaaccctgtcc<br>ctttctcccggggaacgggctaccctttcttgtcgggcatcacaagatatctcaaa<br>atacctcaattggtatcaacagaagcccgacaggcccctaggcttcttatctacc<br>acacctctcgcctgcatagcgggattcccgcacgctttagcgggtctggaagcggg<br>accgactacactctgaccatctcatctccagcccgaggacttcgccgtctactt<br>ctgccagcagggtaacacccctgccgtacaccttcggccagggcaccaagcttgaga<br>tcaaacatcaccaccatcatcaccatcac |
| 103104<br>CAR12 -<br>Soluble<br>scFv - aa | 75 | MALPVTALLLPLALLLHAARPqvqlqesgpglvkpsetlsltctvsgvslpdygvs<br>wirqppgkglewigviwgsettyynsslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleikhhhhhhhh |
| 105977<br>CAR 12 -<br>Full - nt | 101 | atggccctccctgtcaccgccctgctgcttccgctggctcttctgctccacgccgc<br>tcggcccgaaattgtgatgacccagtcacccgccactcttagcctttcaccggtg<br>agcgcgcaaccctgtcttgcagagcctcccaagacatctcaaataccttaattgg<br>tatcaacagaagcccggacaggctcctcgccttctgatctaccacaccagccggct<br>ccattctggaatcctgccaggttcagcggtagcggatctgggaccgactcaccc<br>tcactatcagctcactgcagccagaggacttcgctgtctatttctgtcagcaaggg<br>aacacccctgccctacacctttggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttggggctctgagactacttactacaactcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagcaccactaccccagcaccgaggccaccccacccccggctcctaccatcgcctcc<br>cagcctctgtccctgcgtccggaggcatgtagacccgcagctggtggggccgtgca<br>tacccggggtcttgacttcgcctgcgatatctacatttgggcccctctggctggta<br>cttgcggggtcctgctgctttcactcgtgatcactcttttactgtaagcgcggtcgg<br>aagaagctgctgtacatctttaagcaaccccttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaac<br>cagctctacaacgaactcaatcttggtcggagagaggagtacgacgtgctggacaa<br>gcggagaggacgggacccagaaatgggcgggaagccgcgcagaaagaatcccaag<br>agggcctgtacaacgagctccaaaaggataagatggcagaagcctatagcgagatt<br>ggtatgaaggggaacgcagaagaggcaaaggccacgacggactgtaccagggact<br>cagcaccgccaccaaggacacctatgacgctcttcacatgcaggccctgccgcctc<br>gg |
| 105977<br>CAR 12 -<br>Full - aa | 88 | MALPVTALLLPLALLLHAARPEIVMTQSPATLSLSPGERATLSCRASQDISKYLNW<br>YQQKPGQAPRLLIYHTSRLHSGIPARFSGSGSGTDYTLTISSLQPEDFAVYFCQQG<br>NTLPYTFGQGTKLEIKGGGGSGGGGSGGGGSQVQLQESGPGLVKPSETLSLTCTVS<br>GVSLPDYGVSWIRQPPGKGLEWIGVIWGSETTYYNSSLKSRVTISKDNSKNQVSLK<br>LSSVTAADTAVYYCAKHYYYGGSYAMDYWGQGTLVTVSSTTTPAPRPPTPAPTIAS<br>QPLSLRPEACRPAAGGAVHTRGLDFACDIYIWAPLAGTCGVLLLSLVITLYCKRGR<br>KKLLYIFKQPFMRPVQTTQEEDGCSCRFPEEEEGGCELRVKFSRSADAPAYKQGQN<br>QLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |
| | | CTL019 |
| CTL019 -<br>Soluble<br>scFv - Histag -<br>nt | 141 | Atggccctgccgtcaccgctctgctgctgccccttgctctgcttcttcatgcagc<br>aaggccggacatccagatgacccaaaccacctcatccctctctgcctctctggag<br>acagggtgaccatttcttgtcgcgccagccaggacatcagcaagtatctgaactgg<br>tatcagcagaaagcggacggaaccgtgaagctcctgatctaccataccctctcgcct<br>gcatagcggcgtgccctcacgcttctctggaagcggatcaggaaccgattattctc<br>tcactatttcaaatctcgagcaggaagatattgccacctatttctgccagcaggt<br>aatacccctgccctacaccttcggaggagggaccaagctcgaaatcaccggtggagg<br>aggcagcggcggtggagggtctggtggaggtggttctgaggtgaagctgcaagaat<br>caggccctggacttgtggcccttcacagtccctgagcgtgacttgcaccgtgtcc<br>ggagtctccctgcccgactacggagtgtcatggatcagacaacctccacggaaagg<br>actggaatggctcggtgtcatctgggggtagcgaaactacttactacaattcagccc |

TABLE 4-continued

CD19 CAR Constructs

| Name | SEQ ID | Sequence |
|---|---|---|
| | | tcaaaagcaggctgactattatcaaggacaacagcaagtcccaagtctttcttaag<br>atgaactcactccagactgacgacaccgcaatctactattgtgctaagcactacta<br>ctacggaggatcctacgctatggattactggggacaaggtacttccgtcactgtct<br>cttcacaccatcatcaccatcaccatcac |
| CTL019 - Soluble scFv - Histag - aa | 76 | MALPVTALLLPLALLLHAARPdiqmtqttsslsaslgdrvtiscrasqdiskylnw<br>yqqkpdgtvklliyhtsrlhsgvpsrfsgsgsgtdysltisnleqediatyfcqqg<br>ntlpytfgggtkleitggggsggggsggggsevklqesgpglvapsqslsvtctvs<br>gvslpdygvswirqpprkglewlgviwgsettyynsalksrltiikdnsksqvflk<br>mnslqtddtaiyycakhyyygsyamdywgqgtsvtvss<u>hhhhhhhh</u> |
| CTL019 Full - nt | 102 | atggccttaccagtgaccgccttgctcctgccgctggccttgctgctccacgccgc<br>caggccggacatccagatgacacagactacatcctccctgtctgcctctctgggag<br>acagagtcaccatcagttgcagggcaagtcaggacattagtaaatatttaaattgg<br>tatcagcagaaaccagatggaactgttaaactcctgatctaccatacatcaagatt<br>acactcaggagtcccatcaaggttcagtggcagtgggtctggaacagattattctc<br>tcaccattagcaacctggagcaagaagatattgccacttacttttgccaacaggg t<br>aatacgcttccgtacacgttcggaggggggaccaagctggagatcacaggtggcgg<br>tggctcgggcggtggtgggtcgggtggcggcggatctgaggtgaaactgcaggagt<br>caggacctggcctggtggcgccctcacagagcctgtccgtcacatgcactgtctca<br>gggg tctcattacccgactatggtgtaagctggattcgccagcctccacgaaaggg<br>tctggagtggctgggagtaatatgggg tagtgaaaccacatactataattcagctc<br>tcaaatccagactgaccatcatcaaggacaactccaagagccaagtttcttaaaa<br>atgaacagtctgcaaactgatgacacagccatttactactgtgccaaacattatta<br>ctacggtggtagctatgctatggactactggggccaaggaacctcagtcaccgtct<br>cctcaaccacgacgccagcgccgcgaccaccaacaccggcgccccaccatcgcgtcg<br>cagcccctgtccctgcgcccagaggcgtgccggccagcggcggggggcgcagtgca<br>cacgaggggg ctggacttcgcctgtgatatctacatctgggcgcccttggccggga<br>cttgtggggtccttctcctgtcactggttatcaccctttactgcaaacggggcaga<br>aagaaactcctgtatatattcaaacaaccatttatgagaccagtacaaactactca<br>agaggaagatggctgtagctgccgatttccagaagaagaagaaggaggatgtgaac<br>tgagag tgaagttcagcaggagcgcagacgcccccgcgtacaagcagggccagaac<br>cagctctataacgagctcaatctaggacgaagagaggagtacgatgttttggacaa<br>gagacgtggccgggaccctgagatgggggg aaagccgagaaggaagaaccctcagg<br>aaggcctgtacaatgaactgcagaaagataagatggcggaggcctacagtgagatt<br>gggatgaaaggcgagcgccggaggggcaaggggcacgatggcctttaccagggtct<br>cagtacagccaccaaggacacctacgacgcccttcacatgcaggccctgccccctc<br>gc |
| CTL019 Full - aa (including signal sequence shown in bold) | 89 | MALPVTALLLPLALLLHAARPdiqmtqttsslsaslgdrvtiscrasqdiskylnw<br>yqqkpdgtvklliyhtsrlhsgvpsrfsgsgsgtdysltisnleqediatyfcqqg<br>ntlpytfgggtkleitggggsggggsggggsevklqesgpglvapsqslsvtctvs<br>gvslpdygvswirqpprkglewlgviwgsettyynsalksrltiikdnsksqvflk<br>mnslqtddtaiyycakhyyygsyamdywgqgtsvtvsstttpaprpptpaptias<br>qplslrpeacrpaaggavhtrgldfacdiyiwaplagtcgvlllslvitlyckrgr<br>kkllyifkqpfmrpvqttqeedgcscrfpeeeeggcelrvkfsrsadapaykqgqn<br>qlynelnlgrreeydvldkrrgrdpemggkprrknpqeglynelqkdkmaeaysei<br>gmkgerrrgkghdglyqglstatkdtydalhmqalppr |
| CTL019 scFv domain | 51 | Diqmtqttsslsaslgdrvtiscrasqdiskylnwyqqkpdgtvklliyhtsrlhs<br>gvpsrfsgsgsgtdysltisnleqediatyfcqqgntlpytfgggtkleitgggs<br>ggggsggggsevklqesgpglvapsqslsvtctvsgvslpdygvswirqpprkgle<br>wlgviwgsettyynsalksrltiikdnsksqvflkmnslqtddtaiyycakhyyyg<br>gsyamdywgqgtsvtvss |

Co-Expression of CAR with Other Molecules or Agents
Co-Expression of a Second CAR In one aspect, the CAR-expressing cell described herein can further comprise a second CAR, e.g., a second CAR that includes a different antigen binding domain, e.g., to the same target (e.g., CD19) or a different target (e.g., a target other than CD19, e.g., a target described herein). In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. Placement of a costimulatory signaling domain, e.g., 4-1BB, CD28, CD27, OX-40 or ICOS, onto the first CAR, and the primary signaling domain, e.g., CD3 zeta, on the second CAR can limit the CAR activity to cells where both targets are expressed. In one embodiment, the CAR expressing cell comprises a first CAR that includes an antigen binding domain, a transmembrane domain and a costimulatory domain and a second CAR that targets another antigen and includes an antigen binding domain, a transmembrane domain and a primary signaling domain. In another embodiment, the CAR expressing cell comprises a first CAR that includes an antigen binding domain, a transmembrane domain and a primary signaling domain and a second CAR that targets another antigen and includes an antigen binding domain to the antigen, a transmembrane domain and a costimulatory signaling domain.

In one embodiment, the CAR-expressing cell comprises an XCAR described herein and an inhibitory CAR. In one embodiment, the inhibitory CAR comprises an antigen binding domain that binds an antigen found on normal cells but not cancer cells, e.g., normal cells that also express X. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (CEACAM-1, CEACAM-3, and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGF (e.g., TGFbeta).

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

In some embodiments, the antigen binding domain comprises a single domain antigen binding (SDAB) molecules include molecules whose complementary determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, lamprey, fish, shark, goat, rabbit, and bovine. This term also includes naturally occurring single domain antibody molecules from species other than Camelidae and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. et al. (1993) Nature 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from Camelidae species, for example in camel, llama, dromedary, alpaca and guanaco. Other species besides Camelidae may produce heavy chain molecules naturally devoid of light chain; such VHHs are within the scope of the invention.

The SDAB molecules can be recombinant, CDR-grafted, humanized, camelized, de-immunized and/or in vitro generated (e.g., selected by phage display).

It has also been discovered, that cells having a plurality of chimeric membrane embedded receptors comprising an antigen binding domain that interactions between the antigen binding domain of the receptors can be undesirable, e.g., because it inhibits the ability of one or more of the antigen binding domains to bind its cognate antigen. Accordingly, disclosed herein are cells having a first and a second non-naturally occurring chimeric membrane embedded receptor comprising antigen binding domains that minimize such interactions. Also disclosed herein are nucleic acids encoding a first and a second non-naturally occurring chimeric membrane embedded receptor comprising an antigen binding domains that minimize such interactions, as well as methods of making and using such cells and nucleic acids. In an embodiment the antigen binding domain of one of the first and the second non-naturally occurring chimeric membrane embedded receptor, comprises an scFv, and the other comprises a single VH domain, e.g., a camelid, shark, or lamprey single VH domain, or a single VH domain derived from a human or mouse sequence.

In some embodiments, a composition herein comprises a first and second CAR, wherein the antigen binding domain of one of the first and the second CAR does not comprise a variable light domain and a variable heavy domain. In some embodiments, the antigen binding domain of one of the first and the second CAR is an scFv, and the other is not an scFv. In some embodiments, the antigen binding domain of one of the first and the second CAR comprises a single VH domain, e.g., a camelid, shark, or lamprey single VH domain, or a single VH domain derived from a human or mouse sequence. In some embodiments, the antigen binding domain of one of the first and the second CAR comprises a nanobody. In some embodiments, the antigen binding domain of one of the first and the second CAR comprises a camelid VHH domain.

In some embodiments, the antigen binding domain of one of the first and the second CAR comprises an scFv, and the other comprises a single VH domain, e.g., a camelid, shark, or lamprey single VH domain, or a single VH domain derived from a human or mouse sequence. In some embodiments, the antigen binding domain of one of the first and the second CAR comprises an scFv, and the other comprises a nanobody. In some embodiments, the antigen binding domain of one of the first and the second CAR comprises an scFv, and the other comprises a camelid VHH domain.

In some embodiments, when present on the surface of a cell, binding of the antigen binding domain of the first CAR to its cognate antigen is not substantially reduced by the presence of the second CAR. In some embodiments, binding of the antigen binding domain of the first CAR to its cognate antigen in the presence of the second CAR is 85%, 90%, 95%, 96%, 97%, 98% or 99% of binding of the antigen binding domain of the first CAR to its cognate antigen in the absence of the second CAR.

In some embodiments, when present on the surface of a cell, the antigen binding domains of the first and the second CAR, associate with one another less than if both were scFv antigen binding domains. In some embodiments, the antigen binding domains of the first and the second CAR, associate with one another 85%, 90%, 95%, 96%, 97%, 98% or 99% less than if both were scFv antigen binding domains.

Co-Expression of an Agent that Enhances CAR Activity

In another aspect, the CAR-expressing cell described herein can further express another agent, e.g., an agent that enhances the activity or fitness of a CAR-expressing cell.

For example, in one embodiment, the agent can be an agent which inhibits a molecule that modulates or regulates, e.g., inhibits, T cell function. In some embodiments, the molecule that modulates or regulates T cell function is an inhibitory molecule. Inhibitory molecules, e.g., PD1, can, in some embodiments, decrease the ability of a CAR-expressing cell to mount an immune effector response. Examples of inhibitory molecules include PD1, PD-L1, CTLA4, TIM3, LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, or TGF beta.

In embodiments, an agent, e.g., an inhibitory nucleic acid, e.g., a dsRNA, e.g., an siRNA or shRNA; or e.g., an inhibitory protein or system, e.g., a clustered regularly interspaced short palindromic repeats (CRISPR), a transcription-activator like effector nuclease (TALEN), or a zinc finger endonuclease (ZFN), e.g., as described herein, can be used to inhibit expression of a molecule that modulates or regulates, e.g., inhibits, T-cell function in the CAR-expressing cell. In an embodiment the agent is an shRNA, e.g., an shRNA described herein. In an embodiment, the agent that modulates or regulates, e.g., inhibits, T-cell function is inhibited within a CAR-expressing cell. For example, a dsRNA molecule that inhibits expression of a molecule that modulates or regulates, e.g., inhibits, T-cell function is linked to the nucleic acid that encodes a component, e.g., all of the components, of the CAR.

In one embodiment, the agent that inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, or TGF beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1), can be fused to a transmembrane domain and intracellular signaling domains such as 41BB and CD3 zeta (also referred to herein as a PD1 CAR). In one embodiment, the PD1 CAR, when used in combinations with an XCAR described herein, improves the persistence of the T cell. In one embodiment, the CAR is a PD1 CAR comprising the extracellular domain of PD1 indicated as underlined in SEQ ID NO: 105. In one embodiment, the PD1 CAR comprises the amino acid sequence of SEQ ID NO: 105.

(SEQ ID NO: 105)
Malpvtalllplalllhaarppgwfldspdrpwnpptfspallvvtegdn atftcsfsntsesfvlnwyrmspsnqtdklaafpedrsqpgqdcrfrvtq lpngrdfhmsvvrarrndsgtylcgaislapkaqikeslraelrvterra evptahpspsprpagqfqtlvttt paprpptpaptiasqplslrpeacrp aaggavhtrgldfacdiyiwaplagtcgvlllslvitlyckrgrkkllyi fkqpfmrpvqttqeedgcscrfpeeeeggcelrvkfsrsadapaykqgqn qlynelnlgrreeydvldkrrgrdpemggkprrknpqeglynelqkdkma eayseigmkgerrrgkghdglyqglstatkdtydalhmqalppr.

In one embodiment, the PD1 CAR comprises the amino acid sequence provided below (SEQ ID NO:106).

(SEQ ID NO: 106)
pqwfldspdrpwnpptfspallvvtegdnatftcsfsntsesfvlnwyrm spsnqtdklaafpedrsqpgqdcrfrvtqlpngrdfhmsvvrarrndsgt ylcgaislapkaqikeslraelrvterraevptahpspsprpagqfqtlv tttpaprpptpaptiasqplslrpeacrpaaggavhtrgldfacdiyiwa plagtcgvlllslvitlyckrgrkkllyifkqpfmrpvqttqeedgcscr fpeeeeggcelrvkfsrsadapaykqgqnqlynelnlgrreeydvldkrr grdpemggkprrknpqeglynelqkdkmaeayseigmkgerrrgkghdgl yqglstatkdtydalhmqalppr.

In one embodiment, the agent comprises a nucleic acid sequence encoding the PD1 CAR, e.g., the PD1 CAR described herein. In one embodiment, the nucleic acid sequence for the PD1 CAR is shown below, with the PD1 ECD underlined below in SEQ ID NO: 103:

(SEQ ID NO: 103)
atggccctccctgtcactgccctgcttctcccctcgcactcctgctcca cgccgctagacca<u>cccggatggtttctggactctccggatcgcccgtgga</u>

<u>atccccaaccttctcaccggcactcttggttgtgactgagggcgataat</u>

<u>gcgaccttcacgtgctcgttctccaacacctccgaatcattcgtgctgaa</u>

<u>ctggtaccgcatgagcccgtcaaaccagaccgacaagctcgccgcgtttc</u>

<u>cggaagatcggtcgcaaccgggacaggattgtcggttccgcgtgactcaa</u>

<u>ctgccgaatggcagagacttccacatgagcgtggtccgcgctaggcgaaa</u>

<u>cgactccgggacctacctgtgcggagccatctcgctggcgcctaaggccc</u>

<u>aaatcaaagagagcttgagggccgaactgagagtgaccgagcgcagagct</u>

<u>gaggtgccaactgcacatccatcccatcgcctcggcctgcggggcagtt</u>

<u>tcagaccctggtc</u>acgaccactccggcgccgcgcccaccgactccggccc caactatcgcgagccagccctgtcgctgaggccggaagcatgccgccct gccgccggaggtgctgtgcatacccggggattggacttcgcatgcgacat ctacatttgggctcctctcgccggaacttgtggcgtgctccttctgtccc tggtcatcaccctgtactgcaagcggggtcggaaaaagcttctgtacatt ttcaagcagcccttcatgaggcccgtgcaaaccacccaggaggaggacgg ttgctcctgccggttccccgaagaggaagaaggaggttgcgagctgcgcg -continued

```
tgaagttctcccggagcgccgacgccccgcctataagcagggccagaac cagctgtacaacgaactgaacctgggacggcgggaagagtacgatgtgct ggacaagcggcgcggccgggaccccgaaatgggcgggaagcctagaagaa agaaccctcaggaaggcctgtataacgagctgcagaaggacaagatggcc gaggcctactccgaaattgggatgaagggagagcggcggaggggaagggg gcacgacggcctgtaccaaggactgtccaccgccaccaaggacacatacg atgccctgcacatgcaggcccttccccctcgc.
```

In another example, in one embodiment, the agent that enhances the activity of a CAR-expressing cell can be a costimulatory molecule or costimulatory molecule ligand. Examples of costimulatory molecules include MHC class I molecule, BTLA and a Toll ligand receptor, as well as OX40, CD27, CD28, CD5, ICAM-1, LFA-1 (CD11a/CD18), ICOS (CD278), and 4-1BB (CD137). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83., e.g., as described herein. Examples of costimulatory molecule ligands include CD80, CD86, CD40L, ICOSL, CD70, OX40L, 4-1BBL, GITRL, and LIGHT. In embodiments, the costimulatory molecule ligand is a ligand for a costimulatory molecule different from the costimulatory molecule domain of the CAR. In embodiments, the costimulatory molecule ligand is a ligand for a costimulatory molecule that is the same as the costimulatory molecule domain of the CAR. In an embodiment, the costimulatory molecule ligand is 4-1BBL. In an embodiment, the costimulatory ligand is CD80 or CD86. In an embodiment, the costimulatory molecule ligand is CD70. In embodiments, a CAR-expressing immune effector cell described herein can be further engineered to express one or more additional costimulatory molecules or costimulatory molecule ligands.

Co-Expression of CAR with a Chemokine Receptor

In embodiments, the CAR-expressing cell described herein, e.g., CD19 CAR-expressing cell, further comprises a chemokine receptor molecule. Transgenic expression of chemokine receptors CCR2b or CXCR2 in T cells enhances trafficking to CCL2- or CXCL1-secreting solid tumors including melanoma and neuroblastoma (Craddock et al., *J Immunother.* 2010 October; 33(8):780-8 and Kershaw et al., *Hum Gene Ther.* 2002 Nov. 1; 13(16):1971-80). Thus, without wishing to be bound by theory, it is believed that chemokine receptors expressed in CAR-expressing cells that recognize chemokines secreted by tumors, e.g., solid tumors, can improve homing of the CAR-expressing cell to the tumor, facilitate the infiltration of the CAR-expressing cell to the tumor, and enhances antitumor efficacy of the CAR-expressing cell. The chemokine receptor molecule can comprise a naturally occurring or recombinant chemokine receptor or a chemokine-binding fragment thereof. A chemokine receptor molecule suitable for expression in a CAR-expressing cell (e.g., CAR-Tx) described herein include a CXC chemokine receptor (e.g., CXCR1, CXCR2, CXCR3, CXCR4, CXCR5, CXCR6, or CXCR7), a CC chemokine receptor (e.g., CCR1, CCR2, CCR3, CCR4, CCR5, CCR6, CCR7, CCR8, CCR9, CCR10, or CCR11), a CX3C chemokine receptor (e.g., CX3CR1), a XC chemokine receptor (e.g., XCR1), or a chemokine-binding fragment thereof. In one embodiment, the chemokine receptor molecule to be expressed with a CAR described herein is selected based on the chemokine(s) secreted by the tumor. In one embodiment, the CAR-expressing cell described herein further comprises, e.g., expresses, a CCR2b receptor or a CXCR2 receptor. In an embodiment, the CAR described herein and the chemokine receptor molecule are on the same vector or are on two different vectors. In embodiments where the CAR described herein and the chemokine receptor molecule are on the same vector, the CAR and the chemokine receptor molecule are each under control of two different promoters or are under the control of the same promoter.

Nucleic Acid Constructs Encoding a CAR

The present invention also provides an immune effector cell, e.g., made by a method described herein, that includes a nucleic acid molecules encoding one or more CAR constructs described herein. In one aspect, the nucleic acid molecule is provided as a messenger RNA transcript. In one aspect, the nucleic acid molecule is provided as a DNA construct.

The nucleic acid molecules described herein can be a DNA molecule, an RNA molecule, or a combination thereof. In one embodiment, the nucleic acid molecule is an mRNA encoding a CAR polypeptide as described herein. In other embodiments, the nucleic acid molecule is a vector that includes any of the aforesaid nucleic acid molecules.

In one aspect, the antigen binding domain of a CAR of the invention (e.g., a scFv) is encoded by a nucleic acid molecule whose sequence has been codon optimized for expression in a mammalian cell. In one aspect, entire CAR construct of the invention is encoded by a nucleic acid molecule whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

Accordingly, in one aspect, an immune effector cell, e.g., made by a method described herein, includes a nucleic acid molecule encoding a chimeric antigen receptor (CAR), wherein the CAR comprises an antigen binding domain that binds to a tumor antigen described herein, a transmembrane domain (e.g., a transmembrane domain described herein), and an intracellular signaling domain (e.g., an intracellular signaling domain described herein) comprising a stimulatory domain, e.g., a costimulatory signaling domain (e.g., a costimulatory signaling domain described herein) and/or a primary signaling domain (e.g., a primary signaling domain described herein, e.g., a zeta chain described herein).

The present invention also provides vectors in which a nucleic acid molecule encoding a CAR, e.g., a nucleic acid molecule described herein, is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (w), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR is an adenoviral vector (A5/35). In another embodiment, the expression of nucleic acids encoding CARs can be accomplished using of transposons such as sleeping beauty, crisper, CAS9, and zinc finger nucleases. See below June et al. 2009 Nature Reviews Immunology 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription. Exemplary promoters include the CMV IE gene, EF-1α, ubiquitin C, or phosphoglycerokinase (PGK) promoters.

An example of a promoter that is capable of expressing a CAR encoding nucleic acid molecule in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from nucleic acid molecules cloned into a lentiviral vector. See, e.g., Milone et al., Mol. Ther. 17(8): 1453-1464 (2009). In one aspect, the EF1a promoter comprises the sequence provided in the Examples.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

WT PGK Promoter:

(SEQ ID NO: 982)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT

TACACGCTCTGGGTCCCAGCCGCGGCGACGCAAAGGGCCTTGGTGCGGGT

CTCGTCGGCGCAGGGACGCGTTTGGGTCCCGACGGAACCTTTTCCGCGTT

GGGGTTGGGGCACCATAAGCT.

Exemplary Truncated PGK Promoters:

PGK100:
(SEQ ID NO: 983)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTG.

PGK200:
(SEQ ID NO: 984)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACG.

PGK300:
(SEQ ID NO: 985)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCG.

PGK400:
(SEQ ID NO: 986)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

-continued
GTGTTCCCATCGCCGCTTCTAGGCCCACTGCGACGCTTGCCTGCACTTCT

TACACGCTCTGGGTCCCAGCCG.

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In embodiments, the vector may comprise two or more nucleic acid sequences encoding a CAR, e.g., a CAR described herein, e.g., a CD19 CAR, and a second CAR, e.g., an inhibitory CAR or a CAR that specifically binds to an antigen other than CD19. In such embodiments, the two or more nucleic acid sequences encoding the CAR are encoded by a single nucleic molecule in the same frame and as a single polypeptide chain. In this aspect, the two or more CARs, can, e.g., be separated by one or more peptide cleavage sites. (e.g., an auto-cleavage site or a substrate for an intracellular protease). Examples of peptide cleavage sites include T2A, P2A, E2A, or F2A sites. Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art.

See, for example, Sambrook et al., 2012, MOLECULAR CLONING: A LABORATORY MANUAL, volumes 1-4, Cold Spring Harbor Press, NY). A suitable method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Chol") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant nucleic acid sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Once a CAR described herein is made, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a CAR of the present invention are described in further detail below Western blot analysis of CAR expression in primary T cells can be used to detect the presence of monomers and dimers, e.g., as described in paragraph 695 of International Application WO2015/142675, filed Mar. 13, 2015, which is herein incorporated by reference in its entirety.

In vitro expansion of $CAR^+$ T cells following antigen stimulation can be measured by flow cytometry. For example, a mixture of $CD4^+$ and $CD8^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the $CD4^+$ and/or $CD8^+$ T cell subsets by flow cytometry. See, e.g., Milone et al., Molecular Therapy 17(8): 1453-1464 (2009). Alternatively, a mixture of $CD4^+$ and $CD8^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either a cancer associated antigen as described herein$^+$ K562 cells (K562-expressing a cancer associated antigen as described herein), wild-type K562 cells (K562 wild type) or K562 cells expressing hCD32 and 4-1BBL in the presence of antiCD3 and anti-CD28 antibody (K562-BBL-3/28) following washing. Exogenous IL-2 is added to the cultures every other day at 100 IU/ml. $GFP^+$ T cells are enumerated by flow cytometry using bead-based counting. See, e.g., Milone et al., Molecular Therapy 17(8): 1453-1464 (2009).

Sustained $CAR^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CAR-expressing cell activity, e.g., as described in paragraph 698 of International Application WO2015/142675, filed Mar. 13, 2015, which is herein incorporated by reference in its entirety.

Dose dependent CAR treatment response can be evaluated, e.g., as described in paragraph 699 of International Application WO2015/142675, filed Mar. 13, 2015, which is herein incorporated by reference in its entirety. Assessment of cell proliferation and cytokine production has been previously described, e.g., at Milone et al., Molecular Therapy 17(8): 1453-1464 (2009), e.g., as described in paragraph 700 of International Application WO2015/142675, filed Mar. 13, 2015, which is herein incorporated by reference in its entirety. Cytotoxicity can be assessed by a standard 51Cr-release assay, e.g., as described in paragraph 701 of International Application WO2015/142675, filed Mar. 13, 2015, which is herein incorporated by reference in its entirety. Cytotoxicity can also be assessed by measuring changes in adherent cell's electrical impedance, e.g., using an xCELLigence real time cell analyzer (RTCA). In some embodiments, cytotoxicity is measured at multiple time points.

Imaging technologies can be used to evaluate specific trafficking and proliferation of CARs in tumor-bearing animal models, e.g., as described in paragraph 702 of International Application WO2015/142675, filed Mar. 13, 2015, which is herein incorporated by reference in its entirety. Other assays, including those described in the Example section herein as well as those that are known in the art can also be used to evaluate the CARs described herein.

Strategies for Regulating Chimeric Antigen Receptors

There are many ways CAR activities can be regulated. For example, inducible apoptosis using, e.g., a caspase fused to a dimerization domain (see, e.g., Di Stasa et al., N Egnl. J. Med. 2011 Nov. 3; 365(18):1673-1683), can be used as a safety switch in the CAR therapy of the instant invention. In one embodiment, the cells (e.g., T cells or NK cells) expressing a CAR of the present invention further comprise an inducible apoptosis switch, wherein a human caspase (e.g., caspase 9) or a modified version is fused to a modification of the human FKB protein that allows conditional dimerization. In the presence of a small molecule, such as a rapalog (e.g., AP 1903, AP20187), the inducible caspase (e.g., caspase 9) is activated and leads to the rapid apoptosis and death of the cells (e.g., T cells or NK cells) expressing a CAR of the present invention. Examples of a caspase-based inducible apoptosis switch (or one or more aspects of such a switch) have been described in, e.g., US2004040047; US20110286980; US20140255360; WO1997031899; WO2014151960; WO2014164348; WO2014197638; WO2014197638; all of which are incorporated by reference herein.

In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. Cancer Gene Ther. 2008; 15(10):667-75; Clinical Trial Id. No. NCT02107963; and Di Stasi et al. N. Engl. J. Med. 2011; 365:1673-83.

Alternative strategies for regulating the CAR therapy of the instant invention include utilizing small molecules or antibodies that deactivate or turn off CAR activity, e.g., by depleting CAR-expressing cells, e.g., by inducing antibody dependent cell-mediated cytotoxicity (ADCC).

In one embodiment, the CAR therapy includes administration of a T cell depleting agent. In one embodiment, the T cell depleting agent is an agent that depletes CAR-expressing cells, e.g., by inducing antibody dependent cell-mediated cytotoxicity (ADCC) and/or complement-induced cell death. For example, CAR-expressing cells described herein may also express an antigen (e.g., a target antigen) that is recognized by molecules capable of inducing cell death, e.g., ADCC or complement-induced cell death. For example, CAR expressing cells described herein may also express a target protein (e.g., a receptor) capable of being targeted by an antibody or antibody fragment. Examples of such target proteins include, but are not limited to, EpCAM, VEGFR, integrins (e.g., integrins αvβ3, α4, αI3/4β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/1gE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

In other embodiments, a CAR-expressing cell described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., Gene Ther. 2013; 20(8) 853-860). Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., Blood. 2014; 124(8)1277-1287). Other methods for depleting CAR-expressing cells described herein include administration of CAMPATH, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g., ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In other embodiments, a CAR-expressing cell described herein may also express a target protein recognized by the T cell depleting agent. In one embodiment, the target protein is CD20 and the T cell depleting agent is an anti-CD20 antibody, e.g., rituximab. In such embodiment, the T cell depleting agent is administered once it is desirable to reduce or eliminate the CAR-expressing cell, e.g., to mitigate the CAR induced toxicity. In other embodiments, the T cell depleting agent is an anti-CD52 antibody, e.g., alemtuzumab, as described in the Examples herein.

In some embodiments, the methods disclosed herein further include administering a T cell depleting agent after treatment with the cell (e.g., an immune effector cell as described herein), thereby reducing (e.g., depleting) the CAR-expressing cells (e.g., the CD19CAR-expressing cells). Such T cell depleting agents can be used to effectively deplete CAR-expressing cells (e.g., CD19CAR-expressing cells) to mitigate toxicity. In some embodiments, the CAR-expressing cells were manufactured according to a method herein, e.g., assayed (e.g., before or after transfection or transduction) according to a method herein.

In some embodiments, the T cell depleting agent is administered one, two, three, four, or five weeks after administration of the cell, e.g., the population of immune effector cells, described herein.

In some embodiments, the CAR expressing cell co-expresses the CAR and the target protein, e.g., naturally expresses the target protein or is engineered to express the target protein. For example, the cell, e.g., the population of immune effector cells, can include a nucleic acid (e.g., vector) comprising the CAR nucleic acid (e.g., a CAR nucleic acid as described herein) and a nucleic acid encoding the target protein.

In one embodiment, the T cell depleting agent is a CD52 inhibitor, e.g., an anti-CD52 antibody molecule, e.g., alemtuzumab.

In other embodiments, the cell, e.g., the population of immune effector cells, expresses a CAR molecule as described herein (e.g., CD19CAR) and the target protein recognized by the T cell depleting agent. In one embodiment, the target protein is CD20. In embodiments where the target protein is CD20, the T cell depleting agent is an anti-CD20 antibody, e.g., rituximab.

In further embodiments of any of the aforesaid methods, the methods further include transplanting a cell, e.g., a hematopoietic stem cell, or a bone marrow, into the subject.

In another aspect, the invention features a method of conditioning a subject prior to cell transplantation. The method includes administering to the subject an effective amount of the cell comprising a CAR nucleic acid or polypeptide, e.g., a CD19 CAR nucleic acid or polypeptide. In some embodiments, the cell transplantation is a stem cell transplantation, e.g., a hematopoietic stem cell transplantation, or a bone marrow transplantation. In other embodiments, conditioning a subject prior to cell transplantation includes reducing the number of target-expressing cells in a subject, e.g., CD19-expressing normal cells or CD19-expressing cancer cells.

RCARs

In other embodiments, a regulatable CAR (RCAR) where the CAR activity can be controlled is desirable to optimize the safety and efficacy of a CAR therapy. An RCAR can comprise a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. In one embodiment, a CAR of the present invention utilizes a dimerization switch as those described in, e.g., WO2014127261, which is incorporated by reference herein.

Additional description and exemplary configurations of such regulatable CARs are provided herein and in, e.g., paragraphs 527-551 of International Publication No. WO 2015/090229 filed Mar. 13, 2015, which is incorporated by reference in its entirety. In some embodiments, an RCAR involves a switch domain, e.g., a FKBP switch domain, as set out SEQ ID NO: 131, or comprise a fragment of FKBP having the ability to bind with FRB, e.g., as set out in SEQ ID NO: 132. In some embodiments, the RCAR involves a switch domain comprising a FRB sequence, e.g., as set out in SEQ ID NO: 116, or a mutant FRB sequence, e.g., as set out in any of SEQ ID Nos. 134-139.

In an aspect, an RCAR comprises two polypeptides or members: 1) an intracellular signaling member comprising an intracellular signaling domain, e.g., a primary intracellular signaling domain described herein, and a first switch domain; 2) an antigen binding member comprising an antigen binding domain, e.g., that targets CD19, as described herein and a second switch domain. Optionally, the RCAR comprises a transmembrane domain described herein. In an embodiment, a transmembrane domain can be disposed on the intracellular signaling member, on the antigen binding member, or on both. (Unless otherwise indicated, when members or elements of an RCAR are described herein, the order can be as provided, but other orders are included as well. In other words, in an embodiment, the order is as set out in the text, but in other embodiments, the order can be different. E.g., the order of elements on one side of a transmembrane region can be different from the example, e.g., the placement of a switch domain relative to a intracellular signaling domain can be different, e.g., reversed).

In an embodiment, the first and second switch domains can form an intracellular or an extracellular dimerization switch. In an embodiment, the dimerization switch can be a homodimerization switch, e.g., where the first and second switch domain are the same, or a heterodimerization switch, e.g., where the first and second switch domain are different from one another.

In embodiments, an RCAR can comprise a "multi switch." A multi switch can comprise heterodimerization switch domains or homodimerization switch domains. A multi switch comprises a plurality of, e.g., 2, 3, 4, 5, 6, 7, 8, 9, or 10, switch domains, independently, on a first member, e.g., an antigen binding member, and a second member, e.g., an intracellular signaling member. In an embodiment, the first member can comprise a plurality of first switch domains, e.g., FKBP-based switch domains, and the second member can comprise a plurality of second switch domains, e.g., FRB-based switch domains. In an embodiment, the first member can comprise a first and a second switch domain, e.g., a FKBP-based switch domain and a FRB-based switch domain, and the second member can comprise a first and a second switch domain, e.g., a FKBP-based switch domain and a FRB-based switch domain.

In an embodiment, the intracellular signaling member comprises one or more intracellular signaling domains, e.g., a primary intracellular signaling domain and one or more costimulatory signaling domains.

In an embodiment, the antigen binding member may comprise one or more intracellular signaling domains, e.g., one or more costimulatory signaling domains. In an embodiment, the antigen binding member comprises a plurality, e.g., 2 or 3 costimulatory signaling domains described herein, e.g., selected from 41BB, CD28, CD27, ICOS, and OX40, and in embodiments, no primary intracellular signaling domain. In an embodiment, the antigen binding member comprises the following costimulatory signaling domains, from the extracellular to intracellular direction: 41BB-CD27; 41BB-CD27; CD27-41BB; 41BB-CD28; CD28-41BB; OX40-CD28; CD28-OX40; CD28-41BB; or 41BB-CD28. In such embodiments, the intracellular binding member comprises a CD3zeta domain. In one such embodiment the RCAR comprises (1) an antigen binding member comprising, an antigen binding domain, a transmembrane domain, and two costimulatory domains and a first switch domain; and (2) an intracellular signaling domain comprising a transmembrane domain or membrane tethering domain and at least one primary intracellular signaling domain, and a second switch domain.

An embodiment provides RCARs wherein the antigen binding member is not tethered to the surface of the CAR cell. This allows a cell having an intracellular signaling member to be conveniently paired with one or more antigen binding domains, without transforming the cell with a sequence that encodes the antigen binding member. In such embodiments, the RCAR comprises: 1) an intracellular signaling member comprising: a first switch domain, a transmembrane domain, an intracellular signaling domain, e.g., a primary intracellular signaling domain, and a first switch domain; and 2) an antigen binding member comprising: an antigen binding domain, and a second switch domain, wherein the antigen binding member does not comprise a transmembrane domain or membrane tethering domain, and, optionally, does not comprise an intracellular signaling domain. In some embodiments, the RCAR may further comprise 3) a second antigen binding member comprising: a second antigen binding domain, e.g., a second antigen binding domain that binds a different antigen than is bound by the antigen binding domain; and a second switch domain.

Also provided herein are RCARs wherein the antigen binding member comprises bispecific activation and targeting capacity. In this embodiment, the antigen binding member can comprise a plurality, e.g., 2, 3, 4, or 5 antigen binding domains, e.g., scFvs, wherein each antigen binding domain binds to a target antigen, e.g. different antigens or the same antigen, e.g., the same or different epitopes on the same antigen. In an embodiment, the plurality of antigen binding domains are in tandem, and optionally, a linker or hinge region is disposed between each of the antigen binding domains. Suitable linkers and hinge regions are described herein.

An embodiment provides RCARs having a configuration that allows switching of proliferation. In this embodiment, the RCAR comprises: 1) an intracellular signaling member comprising: optionally, a transmembrane domain or membrane tethering domain; one or more co-stimulatory signaling domain, e.g., selected from 41BB, CD28, CD27, ICOS, and OX40, and a switch domain; and 2) an antigen binding member comprising: an antigen binding domain, a transmembrane domain, and a primary intracellular signaling domain, e.g., a CD3zeta domain, wherein the antigen binding member does not comprise a switch domain, or does not comprise a switch domain that dimerizes with a switch domain on the intracellular signaling member. In an embodiment, the antigen binding member does not comprise a co-stimulatory signaling domain. In an embodiment, the intracellular signaling member comprises a switch domain from a homodimerization switch. In an embodiment, the intracellular signaling member comprises a first switch domain of a heterodimerization switch and the RCAR comprises a second intracellular signaling member which comprises a second switch domain of the heterodimerization switch. In such embodiments, the second intracellular signaling member comprises the same intracellular signaling domains as the intracellular signaling member. In an embodiment, the dimerization switch is intracellular. In an embodiment, the dimerization switch is extracellular.

In any of the RCAR configurations described here, the first and second switch domains comprise a FKBP-FRB based switch as described herein.

Also provided herein are cells comprising an RCAR described herein. Any cell that is engineered to express a RCAR can be used as a RCARX cell. In an embodiment the RCARX cell is a T cell, and is referred to as a RCART cell. In an embodiment the RCARX cell is an NK cell, and is referred to as a RCARN cell.

Also provided herein are nucleic acids and vectors comprising RCAR encoding sequences. Sequence encoding various elements of an RCAR can be disposed on the same nucleic acid molecule, e.g., the same plasmid or vector, e.g., viral vector, e.g., lentiviral vector. In an embodiment, (i) sequence encoding an antigen binding member and (ii) sequence encoding an intracellular signaling member, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In an embodiment, a first promoter is operably linked to (i) and a second promoter is operably linked to (ii), such that (i) and (ii) are transcribed as separate mRNAs.

Alternatively, the sequence encoding various elements of an RCAR can be disposed on the different nucleic acid molecules, e.g., different plasmids or vectors, e.g., viral vector, e.g., lentiviral vector. E.g., the (i) sequence encoding an antigen binding member can be present on a first nucleic acid, e.g., a first vector, and the (ii) sequence encoding an intracellular signaling member can be present on the second nucleic acid, e.g., the second vector.

Dimerization Switches

Dimerization switches can be non-covalent or covalent. In a non-covalent dimerization switch, the dimerization molecule promotes a non-covalent interaction between the switch domains. In a covalent dimerization switch, the dimerization molecule promotes a covalent interaction between the switch domains.

In an embodiment, the RCAR comprises a FKBP/FRAP, or FKBP/FRB,-based dimerization switch. FKBP12 (FKBP, or FK506 binding protein) is an abundant cytoplasmic protein that serves as the initial intracellular target for the natural product immunosuppressive drug, rapamycin. Rapamycin binds to FKBP and to the large PI3K homolog FRAP (RAFT, mTOR). FRB is a 93 amino acid portion of FRAP, that is sufficient for binding the FKBP-rapamycin complex (Chen, J., Zheng, X. F., Brown, E. J. & Schreiber, S. L. (1995) Proc Natl Acad Sci USA 92: 4947-51.)

In embodiments, an FKBP/FRAP, e.g., an FKBP/FRB, based switch can use a dimerization molecule, e.g., rapamycin or a rapamycin analog.

The amino acid sequence of FKBP is as follows:

(SEQ ID NO: 131)
D V P D Y A S L G G P S S P K K K R K V S R G <u>V Q</u>
<u>V E T I S P G D G R T F P K R G Q T C V V H Y T G</u>
<u>M L E D G K K F D S S R D R N K P F K F M L G K Q</u>
<u>E V I R G W E E G V A Q M S V G Q R A K L T I S P</u>
<u>D Y A Y G A T G H P G I I P P H A T L V F D V E L</u>
<u>L K L E T S</u> Y

In embodiments, an FKBP switch domain can comprise a fragment of FKBP having the ability to bind with FRB, or a fragment or analog thereof, in the presence of rapamycin or a rapalog, e.g., the underlined portion of SEQ ID NO: 131, which is:

(SEQ ID NO: 132)
V Q V E T I S P G D G R T F P K R G Q T C V V H Y
T G M L E D G K K F D S S R D R N K P F K F M L G
K Q E V I R G W E E G V A Q M S V G Q R A K L T I
S P D Y A Y G A T G H P G I I P P H A T L V F D V
E L L K L E T S

The amino acid sequence of FRB is as follows:

(SEQ ID NO: 133)
ILWHEMWHEG LEEASRLYFG ERNVKGMFEV LEPLHAMMER
GPQTLKETSF NQAYGRDLME AQEWCRKYMK SGNVKDLTQA
WDLYYHVFRR ISK

"FKBP/FRAP, e.g., an FKBP/FRB, based switch" as that term is used herein, refers to a dimerization switch comprising: a first switch domain, which comprises an FKBP fragment or analog thereof having the ability to bind with FRB, or a fragment or analog thereof, in the presence of rapamycin or a rapalog, e.g., RAD001, and has at least 70, 75, 80, 85, 90, 95, 96, 97, 98, or 99% identity with, or differs by no more than 30, 25, 20, 15, 10, 5, 4, 3, 2, or 1 amino acid residues from, the FKBP sequence of SEQ ID NO: 131 or 132; and a second switch domain, which comprises an FRB fragment or analog thereof having the ability to bind with FRB, or a fragment or analog thereof, in the presence of rapamycin or a rapalog, and has at least 70, 75, 80, 85, 90, 95, 96, 97, 98, or 99% identity with, or differs by no more than 30, 25, 20, 15, 10, 5, 4, 3, 2, or 1 amino acid residues from, the FRB sequence of SEQ ID NO: 133. In an embodiment, a RCAR described herein comprises one switch domain comprises amino acid residues disclosed in SEQ ID NO: 131 (or SEQ ID NO: 132), and one switch domain comprises amino acid residues disclosed in SEQ ID NO: 133.

In embodiments, the FKBP/FRB dimerization switch comprises a modified FRB switch domain that exhibits altered, e.g., enhanced, complex formation between an FRB-based switch domain, e.g., the modified FRB switch domain, a FKBP-based switch domain, and the dimerization molecule, e.g., rapamycin or a rapalogue, e.g., RAD001. In an embodiment, the modified FRB switch domain comprises one or more mutations, e.g., 2, 3, 4, 5, 6, 7, 8, 9, 10 or more, selected from mutations at amino acid position(s) L2031, E2032, S2035, R2036, F2039, G2040, T2098, W2101, D2102, Y2105, and F2108, where the wild-type amino acid is mutated to any other naturally-occurring amino acid. In an embodiment, a mutant FRB comprises a mutation at E2032, where E2032 is mutated to phenylalanine (E2032F), methionine (E2032M), arginine (E2032R), valine (E2032V), tyrosine (E2032Y), isoleucine (E2032I), e.g., SEQ ID NO: 134, or leucine (E2032L), e.g., SEQ ID NO: 135. In an embodiment, a mutant FRB comprises a mutation at T2098, where T2098 is mutated to phenylalanine (T2098F) or leucine (T2098L), e.g., SEQ ID NO: 136. In an embodiment, a mutant FRB comprises a mutation at E2032 and at T2098, where E2032 is mutated to any amino acid, and where T2098 is mutated to any amino acid, e.g., SEQ ID NO: 137. In an embodiment, a mutant FRB comprises an E2032I and a T2098L mutation, e.g., SEQ ID NO: 138. In an embodiment, a mutant FRB comprises an E2032L and a T2098L mutation, e.g., SEQ ID NO: 139.

TABLE 5

Exemplary mutant FRB having increased affinity for a dimerization molecule.

| FRB mutant | Amino Acid Sequence | SEQ ID NO: |
|---|---|---|
| E2032I mutant | ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS | 134 |
| E2032L mutant | ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS | 135 |
| T2098L mutant | ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS | 136 |
| E2032, T2098 mutant | ILWHEMWHEGL<u>X</u>EASRLYFGERNVKGMFEVLEPLHAMMERGPQTLKETSFNQAYGRDLMEAQEWCRKYMKSGNVKDL<u>X</u>QAWDLYYHVFRRISKTS | 137 |

TABLE 5-continued

Exemplary mutant FRB having increased affinity for a dimerization molecule.

| FRB mutant | Amino Acid Sequence | SEQ ID NO: |
|---|---|---|
| E2032I, T2098L mutant | ILWHEMWHEGLIEASRLYFGERNVKGMFEVLEPLHAMMERGPQTLKETSFNQ AYGRDLMEAQEWCRKYMKSGNVKDLLQAWDLYYHVFRRISKTS | 138 |
| E2032L, T2098L mutant | ILWHEMWHEGLLEASRLYFGERNVKGMFEVLEPLHAMMERGPQTLKETSFNQ AYGRDLMEAQEWCRKYMKSGNVKDLLQAWDLYYHVFRRISKTS | 139 |

Other suitable dimerization switches include a GyrB-GyrB based dimerization switch, a Gibberellin-based dimerization switch, a tag/binder dimerization switch, and a halo-tag/snap-tag dimerization switch. Following the guidance provided herein, such switches and relevant dimerization molecules will be apparent to one of ordinary skill.

Dimerization Molecule

Association between the switch domains is promoted by the dimerization molecule. In the presence of dimerization molecule interaction or association between switch domains allows for signal transduction between a polypeptide associated with, e.g., fused to, a first switch domain, and a polypeptide associated with, e.g., fused to, a second switch domain. In the presence of non-limiting levels of dimerization molecule signal transduction is increased by 1.1, 1.2, 1.3, 1.4, 1.5, 1.6, 1.7, 1.8, 1.9, 2, 5, 10, 50, 100 fold, e.g., as measured in a system described herein.

Rapamycin and rapamycin analogs (sometimes referred to as rapalogues), e.g., RAD001, can be used as dimerization molecules in a FKBP/FRB-based dimerization switch described herein. In an embodiment the dimerization molecule can be selected from rapamycin (sirolimus), RAD001 (everolimus), zotarolimus, temsirolimus, AP-23573 (ridaforolimus), biolimus and AP21967. Additional rapamycin analogs suitable for use with FKBP/FRB-based dimerization switches are further described in the section entitled "Combination Therapies", or in the subsection entitled "Exemplary mTOR inhibitors".

Natural Killer Cell Receptor (NKR) CARs

In an embodiment, the CAR molecule described herein comprises one or more components of a natural killer cell receptor (NKR), thereby forming an NKR-CAR. The NKR component can be a transmembrane domain, a hinge domain, or a cytoplasmic domain from any of the following natural killer cell receptors: killer cell immunoglobulin-like receptor (KIR), e.g., KIR2DL1, KIR2DL2/L3, KIR2DL4, KIR2DL5A, KIR2DL5B, KIR2DS1, KIR2DS2, KIR2DS3, KIR2DS4, DIR2DS5, KIR3DL1/S1, KIR3DL2, KIR3DL3, KIR2DP1, and KIR3DP1; natural cytotoxicity receptor (NCR), e.g., NKp30, NKp44, NKp46; signaling lymphocyte activation molecule (SLAM) family of immune cell receptors, e.g., CD48, CD229, 2B4, CD84, NTB-A, CRACC, BLAME, and CD2F-10; Fc receptor (FcR), e.g., CD16, and CD64; and Ly49 receptors, e.g., LY49A, LY49C. The NKR-CAR molecules described herein may interact with an adaptor molecule or intracellular signaling domain, e.g., DAP12. Exemplary configurations and sequences of CAR molecules comprising NKR components are described in International Publication No. WO2014/145252, the contents of which are hereby incorporated by reference.

Split CAR

In some embodiments, the CAR-expressing cell comprises a split CAR. The split CAR approach is described in more detail in publications WO2014/055442 and WO2014/055657. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

CAR Ligands and Uses Thereof

Alternatively, or in combination to the methods disclosed herein, methods and compositions for one or more of: detection and/or quantification of CAR-expressing cells (e.g., in vitro or in vivo (e.g., clinical monitoring)); immune cell expansion and/or activation; and/or CAR-specific selection, that involve the use of a CAR ligand, are disclosed. In one exemplary embodiment, the CAR ligand is an antibody that binds to the CAR molecule, e.g., binds to the extracellular antigen binding domain of CAR (e.g., an antibody that binds to the antigen binding domain, e.g., an anti-idiotypic antibody; or an antibody that binds to a constant region of the extracellular binding domain). In other embodiments, the CAR ligand is a CAR antigen molecule (e.g., a CAR antigen molecule as described herein).

In one aspect, a method for detecting and/or quantifying CAR-expressing cells is disclosed. For example, the CAR ligand can be used to detect and/or quantify CAR-expressing cells in vitro or in vivo (e.g., clinical monitoring of CAR-expressing cells in a patient, or dosing a patient). The method includes:

providing the CAR ligand (optionally, a labelled CAR ligand, e.g., a CAR ligand that includes a tag, a bead, a radioactive or fluorescent label);

acquiring the CAR-expressing cell (e.g., acquiring a sample containing CAR-expressing cells, such as a manufacturing sample or a clinical sample);

contacting the CAR-expressing cell with the CAR ligand under conditions where binding occurs, thereby detecting the level (e.g., amount) of the CAR-expressing cells present. Binding of the CAR-expressing cell with the CAR ligand can be detected using standard techniques such as FACS, ELISA and the like.

In another aspect, a method of expanding and/or activating cells (e.g., immune effector cells) is disclosed. The method includes:

providing a CAR-expressing cell (e.g., a first CAR-expressing cell or a transiently expressing CAR cell);

contacting said CAR-expressing cell with a CAR ligand, e.g., a CAR ligand as described herein), under conditions where immune cell expansion and/or proliferation occurs, thereby producing the activated and/or expanded cell population.

In certain embodiments, the CAR ligand is present on (e.g., is immobilized or attached to a substrate, e.g., a non-naturally occurring substrate). In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the CAR ligand is present in the substrate (e.g., on the substrate surface). The CAR ligand can be immobilized, attached, or associated covalently or non-covalently (e.g., cross-linked) to the substrate. In one embodiment, the CAR ligand is attached (e.g., covalently attached) to a bead. In the aforesaid embodiments, the immune cell population can be expanded in vitro or ex vivo. The method can further include culturing the population of immune cells in the presence of the ligand of the CAR molecule, e.g., using any of the methods described herein.

In other embodiments, the method of expanding and/or activating the cells further comprises addition of a second stimulatory molecule, e.g., CD28. For example, the CAR ligand and the second stimulatory molecule can be immobilized to a substrate, e.g., one or more beads, thereby providing increased cell expansion and/or activation.

In yet another aspect, a method for selecting or enriching for a CAR expressing cell is provided. The method includes contacting the CAR expressing cell with a CAR ligand as described herein; and selecting the cell on the basis of binding of the CAR ligand.

In yet other embodiments, a method for depleting, reducing and/or killing a CAR expressing cell is provided. The method includes contacting the CAR expressing cell with a CAR ligand as described herein; and targeting the cell on the basis of binding of the CAR ligand, thereby reducing the number, and/or killing, the CAR-expressing cell. In one embodiment, the CAR ligand is coupled to a toxic agent (e.g., a toxin or a cell ablative drug). In another embodiment, the anti-idiotypic antibody can cause effector cell activity, e.g., ADCC or ADC activities.

Exemplary anti-CAR antibodies that can be used in the methods disclosed herein are described, e.g., in WO 2014/190273 and by Jena et al., "Chimeric Antigen Receptor (CAR)-Specific Monoclonal Antibody to Detect CD19-Specific T cells in Clinical Trials", PLOS March 2013 8:3 e57838, the contents of which are incorporated by reference. In one embodiment, the anti-idiotypic antibody molecule recognizes an anti-CD19 antibody molecule, e.g., an anti-CD19 scFv. For instance, the anti-idiotypic antibody molecule can compete for binding with the CD19-specific CAR mAb clone no. 136.20.1 described in Jena et al., PLOS March 2013 8:3 e57838; may have the same CDRs (e.g., one or more of, e.g., all of, VH CDR1, VH CDR2, CH CDR3, VL CDR1, VL CDR2, and VL CDR3, using the Kabat definition, the Chothia definition, or a combination of tthe Kabat and Chothia definitions) as the CD19-specific CAR mAb clone no. 136.20.1; may have one or more (e.g., 2) variable regions as the CD19-specific CAR mAb clone no. 136.20.1, or may comprise the CD19-specific CAR mAb clone no. 136.20.1. In some embodiments, the anti-idiotypic antibody was made according to a method described in Jena et al. In another embodiment, the anti-idiotypic antibody molecule is an anti-idiotypic antibody molecule described in WO 2014/190273. In some embodiments, the anti-idiotypic antibody molecule has the same CDRs (e.g., one or more of, e.g., all of, VH CDR1, VH CDR2, CH CDR3, VL CDR1, VL CDR2, and VL CDR3) as an antibody molecule of WO 2014/190273 such as 136.20.1; may have one or more (e.g., 2) variable regions of an antibody molecule of WO 2014/190273, or may comprise an antibody molecule of WO 2014/190273 such as 136.20.1. In other embodiments, the anti-CAR antibody binds to a constant region of the extracellular binding domain of the CAR molecule, e.g., as described in WO 2014/190273. In some embodiments, the anti-CAR antibody binds to a constant region of the extracellular binding domain of the CAR molecule, e.g., a heavy chain constant region (e.g., a CH2-CH3 hinge region) or light chain constant region. For instance, in some embodiments the anti-CAR antibody competes for binding with the 2D3 monoclonal antibody described in WO 2014/190273, has the same CDRs (e.g., one or more of, e.g., all of, VH CDR1, VH CDR2, CH CDR3, VL CDR1, VL CDR2, and VL CDR3) as 2D3, or has one or more (e.g., 2) variable regions of 2D3, or comprises 2D3 as described in WO 2014/190273.

In some aspects and embodiments, the compositions and methods herein are optimized for a specific subset of T cells, e.g., as described in US Serial No. PCT/US2015/043219 filed Jul. 31, 2015, the contents of which are incorporated herein by reference in their entirety. In some embodiments, the optimized subsets of T cells display an enhanced persistence compared to a control T cell, e.g., a T cell of a different type (e.g., CD8+ or CD4+) expressing the same construct.

In some embodiments, a CD4+ T cell comprises a CAR described herein, which CAR comprises an intracellular signaling domain suitable for (e.g., optimized for, e.g., leading to enhanced persistence in) a CD4+ T cell, e.g., an ICOS domain. In some embodiments, a CD8+ T cell comprises a CAR described herein, which CAR comprises an intracellular signaling domain suitable for (e.g., optimized for, e.g., leading to enhanced persistence of) a CD8+ T cell, e.g., a 4-1BB domain, a CD28 domain, or another costimulatory domain other than an ICOS domain. In some embodiments, the CAR described herein comprises an antigen binding domain described herein, e.g., a CAR comprising an antigen binding domain.

In an aspect, described herein is a method of treating a subject, e.g., a subject having cancer. The method includes administering to said subject, an effective amount of:

1) a CD4+ T cell comprising a CAR (the CARCD4+) comprising:
   an antigen binding domain, e.g., an antigen binding domain described herein;
   a transmembrane domain; and
   an intracellular signaling domain, e.g., a first costimulatory domain, e.g., an ICOS domain; and 2) a CD8+ T cell comprising a CAR (the CARCD8+) comprising:
   an antigen binding domain, e.g., an antigen binding domain described herein;
   a transmembrane domain; and
   an intracellular signaling domain, e.g., a second co stimulatory domain, e.g., a 4-1BB domain, a CD28 domain, or another costimulatory domain other than an ICOS domain;
   wherein the CARCD4+ and the CARCD8+ differ from one another.

Optionally, the method further includes administering:

3) a second CD8+ T cell comprising a CAR (the second CARCD8+) comprising:
   an antigen binding domain, e.g., an antigen binding domain described herein;
   a transmembrane domain; and
   an intracellular signaling domain, wherein the second CARCD8+ comprises an intracellular signaling domain, e.g., a costimulatory signaling domain, not present on the CARCD8+, and, optionally, does not comprise an ICOS signaling domain.

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013):166; Williams. Molecular Therapy 16.9(2008):1515-16; Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013):1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic. Exemplary biopolymers are described, e.g., in paragraphs 1004-1006 of International Application WO2015/142675, filed Mar. 13, 2015, which is herein incorporated by reference in its entirety.

Pharmaceutical Compositions and Treatments

In some aspects, the disclosure provides a method of treating a patient, comprising administering CAR-expressing cells manufactured as described herein, optionally in combination with one or more other therapies. In some aspects, the disclosure provides a method of treating a patient, comprising administering a reaction mixture comprising CAR-expressing cells as described herein, optionally in combination with one or more other therapies. In some aspects, the disclosure provides a method of shipping or receiving a reaction mixture comprising CAR-expressing cells as described herein. In some aspects, the disclosure provides a method of treating a patient, comprising receiving a CAR-expressing cell that was manufactured as described herein, and further comprising administering the CAR-expressing cell to the patient, optionally in combination with one or more other therapies. In some aspects, the disclosure provides a method of treating a patient, comprising manufacturing a CAR-expressing cell as described herein, and further comprising administering the CAR-expressing cell to the patient, optionally in combination with one or more other therapies. The other therapy may be, e.g., a cancer therapy such as chemotherapy.

The methods described herein can further include formulating a CAR-expressing cell in a pharmaceutical composition. Pharmaceutical compositions may comprise a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions can be formulated, e.g., for intravenous administration.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-cancer effective amount," "a cancer-inhibiting effective amount," or "therapeutic amount" is indicated, the precise amount of the compositions to be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In some embodiments, a dose of CAR cells (e.g., CD19 CAR cells) comprises about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises at least about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises up to about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises about $1.1\times10^6$-$1.8\times10^7$ cells/kg. In some embodiments, a dose of CAR cells (e.g., CD19 CAR cells) comprises about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD19 CAR cells) comprises at least about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD19 CAR cells) comprises up to about $1\times10^7$, $2\times10^7$, $5\times10^7$, $1\times10^8$, $2\times10^8$, $5\times10^8$, $1\times10^9$, $2\times10^9$, or $5\times10^9$ cells. In certain aspects, it may be desired to administer activated immune effector cells (e.g., T cells, NK cells) to a subject and then subsequently redraw blood (or have an apheresis performed), activate immune effector cells (e.g., T cells, NK cells) therefrom, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

In embodiments, the CAR-expressing cells (e.g., the CD19 CAR-expressing cells) are administered in a plurality of doses, e.g., a first dose, a second dose, and optionally a third dose. In embodiments, the method comprises treating a subject (e.g., an adult subject) having a cancer (e.g., acute lymphoid leukemia (ALL)), comprising administering to the subject a first dose, a second dose, and optionally one or more additional doses, each dose comprising immune effector cells expressing a CAR molecule, e.g., a CD19 CAR molecule, e.g., a CAR molecule according to SEQ ID NO: 89.

In embodiments, the method comprises administering a dose of $2$-$5\times10^6$ viable CAR-expressing cells/kg, wherein the subject has a body mass of less than 50 kg; or administering a dose of $1.0$-$2.5\times10^8$ viable CAR-expressing cells, wherein the subject has a body mass of at least 50 kg.

In embodiments, a single dose is administered to the subject, e.g., pediatric subject.

In embodiments, the doses are administered on sequential days, e.g., the first dose is administered on day 1, the second dose is administered on day 2, and the optional third dose (if administered) is administered on day 3.

In embodiments, a fourth, fifth, or sixth dose, or more doses, are administered.

In embodiments, the first dose comprises about 10% of the total dose, the second dose comprises about 30% of the total dose, and the third dose comprises about 60% of the total dose, wherein the aforementioned percentages have a sum of 100%. In embodiments, the first dose comprises about 9-11%, 8-12%, 7-13%, or 5-15% of the total dose. In embodiments, the second dose comprises about 29-31%, 28-32%, 27-33%, 26-34%, 25-35%, 24-36%, 23-37%, 22-38%, 21-39%, or 20-40% of the total dose. In embodiments, the third dose comprises about 55-65%, 50-70%, 45-75%, or 40-80% of the total dose. In embodiments, the total dose refers to the total number of viable CAR-expressing cells administered over the course of 1 week, 2 weeks, 3 weeks, or 4 weeks. In some embodiments wherein two doses are administered, the total dose refers to the sum of the number of viable CAR-expressing cells administered to the subject in the first and second doses. In some embodiments wherein three doses are administered, the total dose refers to the sum of the number of viable CAR-expressing cells administered to the subject in the first, second, and third doses.

In embodiments, the dose is measured according to the number of viable CAR-expressing cells therein. CAR expression can be measured, e.g., by flow cytometry using an antibody molecule that binds the CAR molecule and a detectable label. Viability can be measured, e.g., by Cellometer.

In embodiments, the viable CAR-expressing cells are administered in ascending doses. In embodiments, the second dose is larger than the first dose, e.g., larger by 10%, 20%, 30%, or 50%. In embodiments, the second dose is twice, three times, four times, or five times the size of the first dose. In embodiments, the third dose is larger than the second dose, e.g., larger by 10%, 20%, 30%, or 50%. In embodiments, the third dose is twice, three times, four times, or five times the size of the second dose.

In certain embodiments, the method includes one, two, three, four, five, six, seven or all of a)-h) of the following:
  a) the number of CAR-expressing, viable cells administered in the first dose is no more than ⅓, of the number of CAR-expressing, viable cells administered in the second dose;

b) the number of CAR-expressing, viable cells administered in the first dose is no more than 1/X, wherein X is 2, 3, 4, 5, 6, 7, 8, 9, 10, 15, 20, 30, 40 or 50, of the total number of CAR-expressing, viable cells administered;
c) the number of CAR-expressing, viable cells administered in the first dose is no more than $1\times10^7$, $2\times10^7$, $3\times10^7$, $4\times10^7$, $5\times10^7$, $6\times10^7$, $7\times10^7$, $8\times10^7$, $9\times10^7$, $1\times10^8$, $2\times10^8$, $3\times10^8$, $4\times10^8$, or $5\times10^8$ CAR-expressing, viable cells, and the second dose is greater than the first dose;
d) the number of CAR-expressing, viable cells administered in the second dose is no more than ½, of the number of CAR-expressing, viable cells administered in the third dose;
e) the number of CAR-expressing, viable cells administered in the second dose is no more than 1/Y, wherein Y is 2, 3, 4, 5, 6, 7, 8, 9, 10, 15, 20, 30, 40 or 50, of the total number of CAR-expressing, viable cells administered;
f) the number of CAR-expressing, viable cells administered in the second dose is no more than $1\times10^7$, $2\times10^7$, $3\times10^7$, $4\times10^7$, $5\times10^7$, $6\times10^7$, $7\times10^7$, $8\times10^7$, $9\times10^7$, $1\times10^8$, $2\times10^8$, $3\times10^8$, $4\times10^8$, or $5\times10^8$ CAR-expressing, viable cells, and the third dose is greater than the second dose;
h) the dosages and time periods of administration of the first, second, and optionally third doses are selected such that the subject experiences CRS at a level no greater than 4, 3, 2, or 1.

In embodiments, the total dose is about $5\times10^8$ CAR-expressing, viable cells. In embodiments, the total dose is about $5\times10^7$-$5\times10^8$ CAR-expressing, viable cells. In embodiments, the first dose is about $5\times10^7$ (e.g., ±10%, 20%, or 30%) CAR-expressing, viable cells, the second dose is about $1.5\times10^8$ (e.g., ±10%, 20%, or 30%) CAR-expressing, viable cells, and the third dose is about $3\times10^8$ (e.g., ±10%, 20%, or 30%) CAR-expressing, viable cells.

In embodiments, the subject is evaluated for CRS after receiving a dose, e.g., after receiving the first dose, the second dose, and/or the third dose.

In embodiments, the subject receives a CRS treatment, e.g., tocilizumab, a corticosteroid, etanercept, or siltuximab. In embodiments, the CRS treatment is administered before or after the first dose of cells comprising the CAR molecule. In embodiments, the CRS treatment is administered before or after the second dose of cells comprising the CAR molecule. In embodiments, the CRS treatment is administered before or after the third dose of cells comprising the CAR molecule. In embodiments, the CRS treatment is administered between the first and second doses of cells comprising the CAR molecule, and/or between the second and third doses of cells comprising the CAR molecule.

The administration of the subject compositions may be carried out in any convenient manner. The compositions described herein may be administered to a patient trans arterially, subcutaneously, intradermally, intratumorally, intranodally, intramedullary, intramuscularly, by intravenous (i.v.) injection, or intraperitoneally, e.g., by intradermal or subcutaneous injection. The compositions of immune effector cells (e.g., T cells, NK cells) may be injected directly into a tumor, lymph node, or site of infection.

In an embodiment, cells expressing a CAR described herein are administered to a subject in combination with a molecule that decreases the $T_{REG}$ cell population. Methods that decrease the number of (e.g., deplete) $T_{REG}$ cells are known in the art and include, e.g., CD25 depletion, cyclophosphamide administration, and modulating GITR function. Without wishing to be bound by theory, it is believed that reducing the number of $T_{REG}$ cells in a subject prior to apheresis or prior to administration of a CAR-expressing cell described herein reduces the number of unwanted immune cells (e.g., Tregs) in the tumor microenvironment and reduces the subject's risk of relapse.

In one embodiment, cells expressing a CAR described herein are administered to a subject in combination with a molecule targeting GITR and/or modulating GITR functions, such as a GITR agonist and/or a GITR antibody that depletes regulatory T cells ($T_{REG}$s). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to administration of the CAR-expressing cell. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to apheresis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In an embodiment, the subject has CLL. In embodiments, the subject has ALL. In embodiments, the subject has a solid cancer, e.g., a solid cancer described herein. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells. In one embodiment, the subject has CLL.

Therapeutic Methods

In one aspect, the disclosure provides methods for treating a disease associated with expression of a tumor antigen described herein.

In one aspect the invention features a method of treating, or providing anti-tumor immunity to, a subject having a cancer, comprising administering to the subject an effective amount of an immune effector cell population, wherein the immune effector cell population is expanded by contacting the population of immune effector cells transiently expressing a first CAR with a cognate antigen.

In another aspect, the invention features a method of treating, or providing anti-tumor immunity to, a subject having a cancer, comprising administering to the subject an effective amount of an immune effector cell population expressing a second CAR, wherein the immune effector cell population is expanded by contacting the population of immune effector cells transiently expressing a first CAR with a cognate antigen, and is further transduced with a vector comprising a nucleic acid encoding a second CAR.

In one aspect, the present disclosure provides methods of treating cancer (e.g., a hematological cancer such as ALL and CLL) by providing to the subject in need thereof immune effector cells (e.g., T cells, NK cells) that are engineered to express a CAR, e.g., a CAR described herein. In one embodiment, the cancer to be treated is a B cell malignancy. In one embodiment, the cancer to be treated is ALL (acute lymphoblastic leukemia), CLL (chronic lymphocytic leukemia), DLBCL (diffuse large B-cell lymphoma), MCL (Mantle cell lymphoma, or MM (multiple myeloma).

In one aspect, the disclosure provides methods of treating cancer (e.g., a hematological cancer such as ALL and CLL) by providing to the subject in need thereof immune effector cells (e.g., T cells, NK cells) that are engineered to express a CAR, e.g., a CAR as described herein, e.g., CD19 CAR, wherein the cancer cells express CD19. In one embodiment, the cancer to be treated is a B cell malignancy. In one embodiment, the cancer to be treated is ALL (acute lymphoblastic leukemia), CLL (chronic lymphocytic leukemia), DLBCL (diffuse large B-cell lymphoma), MCL (Mantle cell lymphoma), Hodgkin's lymphoma, or MM (multiple myeloma).

The disclosure includes a type of cellular therapy where immune effector cells (e.g., T cells, NK cells) are genetically modified (e.g., via transduction of a lentiviral vector) to express a CAR and the CAR-expressing cell is infused to a recipient in need thereof. The infused cell is able to kill tumor cells in the recipient. Unlike antibody therapies, CAR-modified immune effector cells (e.g., T cells, NK cells) are able to replicate in vivo resulting in long-term persistence that can lead to sustained tumor control. CAR-expressing cells (e.g., T cells or NK cells) generated using lentiviral vectors will have stable CAR expression. In various aspects, the immune effector cells (e.g., T cells, NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell to the patient.

The invention also includes a type of cellular therapy where immune effector cells (e.g., T cells, NK cells) are modified, e.g., by in vitro transcribed RNA, to transiently express a CAR and the CAR-expressing cell is infused to a recipient in need thereof. CAR-expressing cells (e.g., T cells, NK cells) generated through transduction of CAR RNA (e.g., by transfection or electroporation) transiently express RNA CARs for 4, 5, 6, 7, 8, 9, 10, 11, 12, 13, 14, 15 days after transduction. The infused cell is able to kill tumor cells in the recipient. Thus, in various aspects, the immune effector cells (e.g., T cells, NK cells) administered to the patient, is present for less than one month, e.g., three weeks, two weeks, one week, after administration of the T cell to the patient.

In one embodiment, the present disclosure provides methods of treating cancer (e.g., a hematological cancer such as ALL and CLL) by providing to the subject in need thereof immune effector cells (e.g., T cells, NK cells) that are engineered to express a CAR that specifically targets or binds to a tumor antigen (or cancer associated antigen) described herein. In yet another embodiment, the method of treatment includes altering the manufacturing of a CAR-expressing cell to enrich for naïve T cells, e.g., as described herein.

In one embodiment, the immune effector cells (e.g., T cells, NK cells) are engineered to express CD19 CAR, for treating a subject having cancer (e.g., a hematological cancer such as ALL and CLL), wherein the cancer cells express CD19. In one embodiment, the cancer to be treated is ALL or CLL. The CD19 CAR molecules to be expressed in an immune effector cell can comprise any anti-CD19 antigen binding domain in the art (e.g., those provided in Table 1 or 4) in combination with any of the CAR domains described herein to generate a full CAR construct. For example, the full CAR construct is a CAR listed in Table 4. Table 4 provides the exemplary full CD19 CAR constructs generated using the various CAR domains (e.g., transmembrane and intracellular signaling domains) described herein, and the anti-CD19 antigen binding domains listed in Table 1 or 4. Amino acid sequences are designated (aa) and nucleic acid sequences are designated (nt).

In one aspect, the disclosure provides methods for treating cancer, e.g., a cancer associated with CD19 expression, with a CAR-expressing cell (e.g., T cell, NK cell) therapy. Exemplary cancers include, but are not limited to e.g., one or more acute leukemias including but not limited to, e.g., B-ALL, T-ALL, ALL; one or more chronic leukemias including but not limited to, e.g., chronic myelogenous leukemia (CML), chronic lymphocytic leukemia (CLL).

Additional cancers or hematological conditions that can be treated with the methods described herein include, but are not limited to, e.g., B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like.

The aforesaid hematological conditions can be associated with expression of CD19. Further, a disease associated with CD19 expression include, but not limited to, e.g., atypical and/or non-classical cancers, malignancies, precancerous conditions or proliferative diseases associated with expression of CD19.

In one embodiment, the disclosure provides methods for treating CLL.

In another embodiment, the disclosure provides methods for treating ALL.

In another embodiment, the disclosure provides methods for treating B-cell ALL.

In one aspect, the disclosure provides methods of treating a subject having cancer (e.g., a hematological cancer such as ALL and CLL) with a CAR-expressing cell (e.g., T cell, NK cell) (e.g., a CD19 CAR-expressing cell (e.g., T cell, NK cell) as described herein, such as, e.g., CTL019). In an embodiment, the disclosure provides methods of treating a subject with a CAR-expressing cell (e.g., T cell, NK cell) in combination with another therapeutic agent, e.g., another therapeutic agent described herein (e.g., another CAR, e.g., another CAR described herein, an inhibitory CAR, e.g., an inhibitory CAR described herein; a chemotherapy; a kinase inhibitor (e.g., a kinase inhibitor described herein, e.g., an mTOR inhibitor, a BTK inhibitor), a checkpoint inhibitor, e.g., a checkpoint inhibitor described herein, a standard of care therapy, etc.). The combination can be, e.g., with any agent described herein.

In an embodiment, stem cell transplantation comprises an autogeneic stem cell transplant. In an embodiment, stem cell transplantation comprises an allogenic stem cell transplant. In an embodiment, stem cell transplantation comprises allogeneic bone marrow transplantation. In an embodiment, stem cell transplantation comprises a hematopoietic stem cell transplantation (HSCT). In an embodiment, hematopoietic stem cells are derived from various tissues including, but not limited to bone marrow, peripheral blood, umbilical cord blood, and combinations thereof.

In one aspect, the disclosure provides methods for treating a disease associated with CD19 expression. In one aspect, the invention provides methods for treating a disease wherein part of the tumor is negative for CD19 and part of the tumor is positive for CD19. For example, provided methods are useful for treating subjects that have undergone treatment for a disease associated with elevated expression of CD19, wherein the subject that has undergone treatment for elevated levels of CD19 exhibits a disease associated with elevated levels of CD19.

In one aspect, provided methods comprise a vector comprising CD19 CAR operably linked to promoter for expression in mammalian cells (e.g., T cells or NK cells). In one aspect, provided methods comprise a recombinant cell (e.g., T cell or NK cell) expressing a CD19 CAR for use in treating CD19-expressing tumors, wherein the recombinant T cell expressing the CD19 CAR is termed a CD19 CAR-expressing cell. In one aspect, a CD19 CAR-expressing cell (e.g., T cell, NK cell) administered according to provided methods is capable of contacting a tumor cell with at least one CD19 CAR expressed on its surface such that the CAR-expressing cell targets the tumor cell and growth of the tumor is inhibited.

In one aspect, the disclosure features to a method of inhibiting growth of a CD19-expressing tumor cell, comprising contacting the tumor cell with a CD19 CAR-expressing cell (e.g., T cell, NK cell) described herein such that the CAR-expressing cell is activated in response to the antigen and targets the cancer cell, wherein the growth of the tumor is inhibited.

In one aspect, the disclosure includes a type of cellular therapy where T cells are genetically modified to express a CAR and the CAR-expressing cell (e.g., T cell, NK cell) is infused to a recipient in need thereof. The infused cell is able to kill tumor cells in the recipient. Unlike antibody therapies, CAR-modified cells (e.g., T cells or NK cells) are able to replicate in vivo resulting in long-term persistence that can lead to sustained tumor control. In various aspects, the cells administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the cell to the patient.

The disclosure also includes a type of cellular therapy where cells (e.g., T cells, NK cells) are modified, e.g., by in vitro transcribed RNA, to transiently express a chimeric antigen receptor (CAR) and the CAR-expressing cell (e.g., T cell, NK cell) is infused to a recipient in need thereof. The infused cell is able to kill tumor cells in the recipient. Thus, in various aspects, the cells administered to the patient, are present for less than one month, e.g., three weeks, two weeks, one week, after administration of the cell (e.g., T cell, NK cell) to the patient.

Without wishing to be bound by any particular theory, the anti-tumor immunity response elicited by the CAR-modified cells (e.g, T cells, NK cells) may be an active or a passive immune response, or alternatively may be due to a direct vs indirect immune response. In one aspect, the CAR transduced T cells exhibit specific proinflammatory cytokine secretion and potent cytolytic activity in response to human cancer cells expressing the CD19, resist soluble CD19 inhibition, mediate bystander killing and mediate regression of an established human tumor. For example, antigen-less tumor cells within a heterogeneous field of CD19-expressing tumor may be susceptible to indirect destruction by CD19-redirected T cells that has previously reacted against adjacent antigen-positive cancer cells.

In one aspect, the fully-human CAR-modified cells (e.g., T cells, NK cells) described herein may be a type of vaccine for ex vivo immunization and/or in vivo therapy in a mammal. In one aspect, the mammal is a human.

With respect to ex vivo immunization, at least one of the following occurs in vitro prior to administering the cell into a subject: i) expansion of the cells, ii) introducing a nucleic acid encoding a CAR to the cells or iii) cryopreservation of the cells.

Ex vivo procedures are known in the art and are discussed more fully below. Briefly, cells are isolated from a subject (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

Hematological Cancers

Hematological cancer conditions are types of cancer such as leukemia and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

The present disclosure provides for compositions and methods for treating cancer. In one aspect, the cancer is a hematologic cancer including but is not limited to a leukemia or a lymphoma. In one aspect, the CAR-expressing cells (e.g., T cells, NK cells) of the invention may be used to treat cancers and malignancies such as, but not limited to, e.g., acute leukemias including but not limited to, e.g., B-ALL, T-ALL, ALL; one or more chronic leukemias including but not limited to, e.g., CML, CLL; additional hematologic cancers or hematologic conditions including, but not limited to, e.g., B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like.

The present disclosure also provides methods for inhibiting the proliferation or reducing a CD19-expressing cell population, the methods comprising contacting a population of cells comprising a CD19-expressing cell with a CD19 CAR-expressing cell (e.g., T cell, NK cell) described herein that binds to the CD19-expressing cell. In a specific aspect, the disclosure provides methods for inhibiting the proliferation or reducing the population of cancer cells expressing CD19, the methods comprising contacting the CD19-expressing cancer cell population with a CD19 CAR-expressing cell (e.g., T cell, NK cell) described herein that binds to the CD19-expressing cell. In one aspect, the present disclosure provides methods for inhibiting the proliferation or reducing the population of cancer cells expressing CD19, the methods comprising contacting the CD19-expressing cancer cell population with a CD19 CAR-expressing cell (e.g., T cell, NK cell) described herein that binds to the CD19-expressing cell. In certain aspects, the anti-CD19 CAR-expressing cell (e.g., T cell, NK cell) reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with CD19-expressing cells relative to a negative control. In one aspect, the subject is a human.

The present disclosure also provides methods for preventing, treating and/or managing a disease associated with CD19-expressing cells (e.g., a hematologic cancer or atypical cancer expressing CD19), the methods comprising administering to a subject in need a CAR-expressing cell (e.g., T cell, NK cell) described herein that binds to the CD19-expressing cell. In one aspect, the subject is a human. Non-limiting examples of disorders associated with CD19-expressing cells include autoimmune disorders (such as lupus), inflammatory disorders (such as allergies and asthma) and cancers (such as hematological cancers or atypical cancers expressing CD19).

The present disclosure also provides methods for preventing, treating and/or managing a disease associated with CD19-expressing cells, the methods comprising administering to a subject in need a CD19 CAR-expressing cell (e.g., T cell, NK cell) described herein that binds to the CD19-expressing cell. In one aspect, the subject is a human.

The present disclosure provides methods for preventing relapse of cancer associated with CD19-expressing cells (e.g., a hematological cancer such as ALL and CLL), the methods comprising administering to a subject in need thereof a CD19 CAR-expressing cell (e.g., T cell, NK cell) described herein that binds to the CD19-expressing cell. In one aspect, the methods comprise administering to the subject in need thereof an effective amount of a CD19 CAR-expressing cell (e.g., T cell, NK cell) described herein that binds to the CD19-expressing cell in combination with an effective amount of another therapy.

Combination Therapy

It will be appreciated that any cancer therapy as described above and herein can be administered in combination with one or more additional therapies to treat and/or reduce the symptoms of cancer described herein. The pharmaceutical compositions can be administered concurrently with, prior to, or subsequent to, one or more other additional therapies or therapeutic agents. In an embodiment, a CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

In further aspects, a CAR-expressing cell described herein may be used in a treatment regimen in combination with surgery, chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation peptide vaccine, such as that described in Izumoto et al. 2008 J NEUROSURG 108:963-971.

In one embodiment, a CAR-expressing cell described herein can be used in combination with a chemotherapeutic agent. Exemplary chemotherapeutic agents include an anthracycline (e.g., doxorubicin (e.g., liposomal doxorubicin)), a *vinca* alkaloid (e.g., vinblastine, vincristine, vindesine, vinorelbine), an alkylating agent (e.g., bendamustine, cyclophosphamide, decarbazine, melphalan, ifosfamide, temozolomide), an immune cell antibody (e.g., alemtuzamab, gemtuzamab, rituximab, tositumomab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide), and combinations thereof.

Exemplary mTOR inhibitors include, without limitation, RAD001, temsirolimus; ridaforolimus (formally known as deferolimus, (1R,2R,4S)-4-[(2R)-2[(1R,9S,12S,15R,16E, 18R,19R,21R,23S,24E,26E,28Z,30S,32S,35R)-1,18-dihydroxy-19,30-dimethoxy-15,17,21,23,29,35-hexamethyl-2,3, 10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methylpyrido[2,3-d]pyrimidin-7(8H)-one (PF04691502, CAS 1013101-36-4); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-, inner salt (SF1126, CAS 936487-67-1) (SEQ ID NO: 140), XL765 and combinations thereof.

Exemplary immunomodulators include, without limitation, afutuzumab (available from Roche®); pegfilgrastim (Neulasta®); lenalidomide (CC-5013, Revlimid®); thalidomide (Thalomid®), actimid (CC4047); IRX-2 (mixture of human cytokines including interleukin 1, interleukin 2, and interferon γ, CAS 951209-71-5, available from IRX Therapeutics) and combinations thereof.

Exemplary anthracyclines include, without limitation, doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; desacetylravidomycin and combinations thereof.

Exemplary *vinca* alkaloids include, without limitation, vinorelbine tartrate (Navelbine®), Vincristine (Oncovin®), Vindesine (Eldisine®)); vinblastine (also known as vinblastine sulfate, vincaleukoblastine and VLB, Alkaban-AQ® and Velban®); vinorelbine (Navelbine®) and combinations thereof.

Exemplary proteosome inhibitors include, without limitation, bortezomib (Velcade®); carfilzomib (PX-171-007, (S)-4-Methyl-N-((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912) and combinations thereof.

Exemplary GITR agonists include, without limitation, GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025, 962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In an embodiment, a CAR expressing cell described herein, such as, e.g., a CD19 CAR-expressing cell (e.g., T cell, NK cell), e.g., CTL019 is administered to a subject, e.g., a subject identified as a partial responder or non-responder, in combination with an mTOR inhibitor, e.g., an mTOR inhibitor described herein, e.g., a target of the rapamycin signaling pathway such as RAD001. In an embodiment, the mTOR inhibitor is administered prior to the CAR-expressing cell. For example, in an embodiment, the mTOR inhibitor can be administered prior to apheresis of the cells. In an embodiment, the subject has cancer (e.g., a hematological cancer such as ALL and CLL). In an embodiment, the subject has ALL. In an embodiment, the subject has CLL.

In an embodiment, a CAR expressing cell described herein, such as, e.g., a CD19 CAR-expressing cell (e.g., T cell, NK cell), e.g., CTL019, is administered to a subject, e.g., a subject identified as a partial responder or non-responder, in combination with a GITR agonist, e.g., a GITR agonist described herein. In an embodiment, the GITR agonist is administered prior to the CAR-expressing cell. For example, in an embodiment, the GITR agonist can be administered prior to apheresis of the cells. In an embodiment, the subject has cancer (e.g., a hematological cancer such as ALL and CLL). In an embodiment, the subject has ALL. In an embodiment, the subject has CLL.

In one embodiment, the subject can be administered an agent which enhances the activity of a CAR-expressing cell. For example, in one embodiment, the agent can be an agent which inhibits an inhibitory molecule. Inhibitory molecules, e.g., Programmed Death 1 (PD1), can, in some embodiments, decrease the ability of a CAR-expressing cell to mount an immune effector response. Examples of inhibitory molecules include PD1, PD-L1, CTLA-4, TIM3, CEACAM (e.g., CEACAM-1, CEACAM-3 and/or CEACAM-5), LAG3, VISTA, BTLA, TIGIT, LAIR1, CD160, 2B4 and TGF beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, or a clustered regularly interspaced short palindromic repeats (CRISPR), a transcription-activator like effector nuclease (TALEN), or a zinc finger endonuclease (ZFN), can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR. In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206).). In an embodiment, the agent is an antibody or antibody fragment that binds to TIM3. In an embodiment, the agent is an antibody or antibody fragment that binds to LAG3. In an embodiment, the agent is an antibody or antibody fragment that binds to CEACAM (e.g., CEACAM-1, CEACAM-3 and/or CEACAM-5).

PD1 is an inhibitory member of the CD28 family of receptors that also includes CD28, CTLA-4, ICOS, and BTLA. PD1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1. Antibodies, antibody fragments, and other inhibitors of PD1, PD-L1 and PD-L2 are available in the art and may be used combination with a CD19 CAR described herein.

For example, nivolumab (also referred to as BMS-936558 or MDX1106; Bristol-Myers Squibb) is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. Pidilizumab (CT-011; Cure Tech) is a humanized IgG1k monoclonal antibody that binds to PD1. Pidilizumab and other humanized anti-PD1 monoclonal antibodies are disclosed in WO2009/101611. Pembrolizumab (formerly known as lambrolizumab, and also referred to as Keytruda, MK03475; Merck) is a humanized IgG4 monoclonal antibody that binds to PD1. Pembrolizumab and other humanized anti-PD1 antibodies are disclosed in U.S. Pat. No. 8,354,509 and WO2009/114335. MEDI4736 (Medimmune) is a human monoclonal antibody that binds to PDL1, and inhibits interaction of the ligand with PD1. MDPL3280A (Genentech/Roche) is a human Fc optimized IgG1 monoclonal antibody that binds to PD-L1. MDPL3280A and other human monoclonal antibodies to PD-L1 are disclosed in U.S. Pat. No. 7,943,743 and U.S Publication No.: 20120039906. Other anti-PD-L1 binding agents include YW243.55.570 (heavy and light chain variable regions are shown in SEQ ID NOs 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD1 and B7-H1. Other anti-PD1 antibodies include AMP 514 (Amplimmune), among others, e.g., anti-PD1 antibodies disclosed in U.S. Pat. No. 8,609,089, US 2010028330, and/or US 20120114649.

In one embodiment, the anti-PD-1 antibody or fragment thereof is an anti-PD-1 antibody molecule as described in US 2015/0210769, entitled "Antibody Molecules to PD-1 and Uses Thereof," incorporated by reference in its entirety. In one embodiment, the anti-PD-1 antibody molecule includes at least one, two, three, four, five or six CDRs (or collectively all of the CDRs) from a heavy and light chain variable region from an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1, or encoded by the nucleotide sequence in Table 1; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-PD-1 antibody molecule comprises at least one, two, three or four variable regions from an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1, or encoded by the nucleotide sequence in Table 1; or as described in Table 1 of US 2015/0210769; or encoded by the nucleotide sequence in Tables 1; or a sequence substantially identical (e.g., at least 80%, 85%, 90%, 92%, 95%, 97%, 98%, 99% or higher identical) to any of the aforesaid sequences.

In one embodiment, the anti-PD-1 antibody molecule includes:

(a) a heavy chain variable region (VH) comprising a VHCDR1 amino acid sequence of SEQ ID NO: 4, a VHCDR2 amino acid sequence of SEQ ID NO: 5, and a VHCDR3 amino acid sequence of SEQ ID NO: 3; and a light chain variable region (VL) comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769;

(b) a VH comprising a VHCDR1 amino acid sequence chosen from SEQ ID NO: 1; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769;

(c) a VH comprising a VHCDR1 amino acid sequence of SEQ ID NO: 224, a VHCDR2 amino acid sequence of SEQ ID NO: 5, and a VHCDR3 amino acid sequence of SEQ ID NO: 3; and a VL comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769; or (d) a VH comprising a VHCDR1 amino acid sequence of SEQ ID NO: 224; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769.

In the combinations herein below, in another embodiment, the anti-PD-1 antibody molecule comprises (i) a heavy chain variable region (VH) comprising a VHCDR1 amino acid sequence chosen from SEQ ID NO: 1, SEQ ID NO: 4, or SEQ ID NO: 224; a VHCDR2 amino acid sequence of SEQ ID NO: 2 or SEQ ID NO: 5; and a VHCDR3 amino acid sequence of SEQ ID NO: 3; and (ii) a light chain variable region (VL) comprising a VLCDR1 amino acid sequence of SEQ ID NO: 10 or SEQ ID NO: 13, a VLCDR2 amino acid sequence of SEQ ID NO: 11 or SEQ ID NO: 14, and a VLCDR3 amino acid sequence of SEQ ID NO: 32 or SEQ ID NO: 33, each disclosed in Table 1 of US 2015/0210769.

In certain embodiments, the anti-PD-1 antibody molecule is administered by injection (e.g., subcutaneously or intravenously) at a dose of about 1 to 30 mg/kg, e.g., about 5 to 25 mg/kg, about 10 to 20 mg/kg, about 1 to 5 mg/kg, or about 3 mg/kg. The dosing schedule can vary from e.g., once a week to once every 2, 3, or 4 weeks. In one embodiment, the anti-PD-1 antibody molecule is administered at a dose from about 1 to 20 mg/kg every other week.

In some embodiments, the dose of a PD-1 inhibitor, e.g., an anti-PD-1 antibody molecule, is a flat dose. In some embodiments, the anti-PD-1 antibody molecule is administered by injection (e.g., subcutaneously or intravenously) at a dose (e.g., a flat dose) of about 200 mg to 500 mg, e.g., about 250 mg to 450 mg, about 300 mg to 400 mg, about 250 mg to 350 mg, about 350 mg to 450 mg, or about 300 mg or about 400 mg. The dosing schedule (e.g., flat dosing schedule) can vary from e.g., once a week to once every 2, 3, 4, 5, or 6 weeks. In one embodiment, the anti-PD-1 antibody molecule is administered at a dose from about 300 mg to 400 mg once every three weeks or once every four weeks. In one embodiment, the anti-PD-1 antibody molecule is administered at a dose from about 300 mg once every three weeks. In one embodiment, the anti-PD-1 antibody molecule is administered at a dose from about 400 mg once every four weeks, e.g., via i.v. infusion. In one embodiment, the anti-PD-1 antibody molecule is administered at a dose from about 300 mg once every four weeks, e.g., via i.v. infusion. In one embodiment, the anti-PD-1 antibody molecule is administered at a dose from about 400 mg once every three weeks, e.g., via i.v. infusion.

In another embodiment, the anti-PD-L1 antibody molecule includes at least one, two, three, four, five or six CDRs (or collectively all of the CDRs) from a heavy and light chain variable region of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1, or encoded by a nucleotide sequence shown in Table 1 of US-2016/0108123. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-L1 antibody molecule includes at least one or two heavy chain variable domain (optionally including a constant region), at least one or two light chain variable domain (optionally including a constant region), or both, comprising the amino acid sequence of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1 of US-2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In one embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 2; and a VHCDR3 amino acid sequence of SEQ ID NO: 3, each disclosed in Table 1 of U.S. Ser. No. 14/881,888; and (ii) a light chain variable region (VL) including a VLCDR1 amino acid sequence of SEQ ID NO: 9, a VLCDR2 amino acid sequence of SEQ ID NO: 10, and a VLCDR3 amino acid sequence of SEQ ID NO: 11, each disclosed in Table 1 of US-2016/0108123.

In another embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 5, and a VHCDR3 amino acid sequence of SEQ ID NO: 3, each disclosed in Table 1 of US-2016/0108123; and (ii) a light chain variable region (VL) including a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Table 1 of US-2016/0108123.

In one embodiment, the anti-PD-L1 antibody molecule comprises the VHCDR1 amino acid sequence of SEQ ID NO: 1. In another embodiment, the anti-PD-L1 antibody molecule comprises the VHCDR1 amino acid sequence of SEQ ID NO: 4. In yet another embodiment, the anti-PD-L1 antibody molecule comprises the VHCDR1 amino acid sequence of SEQ ID NO: 195, each disclosed in Table 1 of US-2016/0108123.

TIM3 (T cell immunoglobulin-3) also negatively regulates T cell function, particularly in IFN-g-secreting CD4+ T helper 1 and CD8+ T cytotoxic 1 cells, and plays a critical role in T cell exhaustion. Inhibition of the interaction between TIM3 and its ligands, e.g., galectin-9 (Ga19), phosphotidylserine (PS), and HMGB1, can increase immune response. Antibodies, antibody fragments, and other inhibitors of TIM3 and its ligands are available in the art and may be used combination with a CAR, e.g., a CD19 CAR, described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In one embodiment, the anti-TIM3 antibody or fragment thereof is an anti-TIM3 antibody molecule as described in US 2015/0218274, entitled "Antibody Molecules to TIM3 and Uses Thereof," incorporated by reference in its entirety.

In one embodiment, the anti-TIM3 antibody molecule includes at least one, two, three, four, five or six CDRs (or collectively all of the CDRs) from a heavy and light chain variable region from an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-TIM3 antibody molecule comprises at least one, two, three or four variable regions from an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences. In other embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. PLoS One. 2010 Sep. 2; 5(9). pii: e12529 (DOI:10:1371/journal.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. J Immunol. 2002 Mar. 15; 168(6): 2803-10; Markel et al. J Immunol. 2006 Nov. 1; 177(9): 6062-71; Markel et al. Immunology. 2009 February; 126(2): 186-200; Markel et al. Cancer Immunol Immunother. 2010 February; 59(2):215-30; Ortenberg et al. Mol Cancer Ther. 2012 June; 11(6):1300-10; Stern et al. J Immunol. 2005 Jun. 1; 174(11):6692-701; Zheng et al. PLoS One. 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) Nature doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CAR, e.g., a CD19 CAR, described herein. For example, BMS-986016 (Bristol-Myers Squib) is a monoclonal antibody that targets LAG3. IMP701 (Immutep) is an antagonist LAG3 antibody and IMP731 (Immutep and GlaxoSmithKline) is a depleting LAG3 antibody. Other LAG3 inhibitors include IMP321 (Immutep), which is a recombinant fusion protein of a soluble portion of LAG3 and Ig that binds to MHC class II molecules and activates antigen presenting cells (APC). Other antibodies are disclosed, e.g., in WO2010/019570.

In one embodiment, the anti-LAG3 antibody or fragment thereof is an anti-LAG3 antibody molecule as described in US 2015/0259420, entitled "Antibody Molecules to LAG3 and Uses Thereof," incorporated by reference in its entirety. In one embodiment, the anti-LAG3 antibody molecule includes at least one, two, three, four, five or six CDRs (or collectively all of the CDRs) from a heavy and light chain variable region from an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Table 1; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-LAG3 antibody molecule comprises at least one, two, three or four variable regions from an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Tables 1; or a sequence substantially identical (e.g., at least 80%, 85%, 90%, 92%, 95%, 97%, 98%, 99% or higher identical) to any of the aforesaid sequences. In some embodiments, the agent which enhances the activity of a CAR-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comprising an intracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell or NK cell that does not express a CD19 CAR.

In one embodiment, the agent which enhances activity of a CAR-expressing cell described herein is miR-17-92.

ROR1 Inhibitors

Also provided herein are ROR1 inhibitors and combination therapies, e.g., combinations of a CAR-expressing cell described herein with a ROR1 inhibitor. The ROR1 inhibitor can be, e.g., a small molecule, antibody, or fragment thereof (e.g., a monospecific or bispecific antibody or fragment thereof); a recombinant protein, e.g., fusion protein, that binds to ROR1; inhibitory nucleic acid; or a cell expressing a ROR1 CAR, e.g., a ROR1 CAR-expressing T cell or NK cell. In one embodiment, the ROR1 inhibitor is an anti-ROR1 expressing cell, e.g., ROR1 CART or ROR1-expressing NK cell. Exemplary ROR1 inhibitors are described in more detail below.

In one embodiment, the present disclosure provides a population of CAR-expressing cells, e.g., CART cells or CAR-expressing NK cells, comprising a mixture of cells expressing ROR1 CARs. For example, in one embodiment, the population of CAR-expressing cells can include a first cell expressing a CD19 CAR and a second cell expressing a ROR1 CAR.

ROR1 inhibitors include but are not limited to anti-ROR1 CAR-expressing cells, e.g. CARTs, and anti-ROR antibodies (e.g., an anti-ROR1 mono- or bispecific antibody) and fragments thereof. In some embodiments, anti-ROR1 inhibitors can be used to treat a disease described herein.

An exemplary anti-ROR1 inhibitor is described in Hudecek, et al. Clin. Cancer Res. 19.12(2013):3153-64, incorporated herein by reference. For example, an anti-ROR1 inhibitor includes the anti-ROR1 CARTs described in Hudecek et al. (for example, generated as described in Hudecek et al. at page 3155, first full paragraph, incorporated herein by reference). In other examples, an anti-ROR1 inhibitor includes an antibody or fragment thereof comprising the VH and/or VL sequences of the 2A2 and R12 anti-ROR1 monoclonal antibodies described in Hudecek et al. at paragraph bridging pages 3154-55; Baskar et al. MAbs 4(2012):349-61; and Yang et al. PLoS ONE 6(2011):e21018, incorporated herein by reference.

In other embodiments, a ROR1 inhibitor includes an antibody or fragment thereof (e.g., single chain variable fragment (scFv)) that targets ROR1, including those described in US 2013/0101607, e.g., SEQ ID NOs: 1 or 2 of US 2013/0101607, incorporated herein by reference. In some embodiments, anti-ROR1 antibody fragments (e.g., scFvs) are conjugated or fused to a biologically active molecule, e.g., to form a chimeric antigen receptor (CAR) that directs immune cells, e.g., T cells or NK cells, to respond to ROR1-expressing cells.

In some embodiments, an exemplary ROR1 inhibitor includes an anti-ROR1 monoclonal antibody called UC-961 (Cirmtuzumab). See, e.g., Clinical Trial Identifier No. NCT02222688. Cirmtuzumab can be used to treat cancers, such as chronic lymphocytic leukemia (CLL), ovarian cancer, and melanoma. See, e.g., Hojjat-Farsangi et al. PLoS One. 8(4): e61167; and NCT02222688. In some embodiments, cirmtuzumab is administered intravenously, e.g., as an intravenous infusion.

In some embodiments, the anti-ROR1 antibody is conjugated or otherwise bound to a therapeutic agent.

In some embodiments, a ROR1 inhibitor includes an anti-ROR1 CAR-expressing cell, e.g., CART, e.g., a cell expressing an anti-ROR1 CAR construct or encoded by a ROR1 binding CAR comprising a scFv, CDRs, or VH and VL chains. For example, an anti-ROR1 CAR-expressing cell, e.g., CART is a generated by engineering a ROR1-CAR (that comprises a ROR1 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and ROR1 CARs. For example, in one embodiment, the population of CAR-expressing cell can include a first cell expressing a CD19 CAR and a second cell expressing a ROR1 CAR. In one embodiment, the population of CAR-expressing cells includes, e.g., a first cell expressing a CAR (e.g., a CD19 CAR, a ROR1 CAR, a CD20 CAR, or a CD22 CAR) that includes a primary intracellular signaling domain, and a second cell expressing a CAR (e.g., a CD19 CAR, a ROR1 CAR, a CD20 CAR, or a CD22 CAR)) that includes a secondary signaling domain.

CD20 Inhibitors

Provided herein are CD20 inhibitors and combination therapies, e.g., combinations of a CAR-expressing cell described herein with a CD20 inhibitor. The CD20 inhibitor can be, e.g., a small molecule, antibody, or fragment thereof (e.g., a monospecific or bispecific antibody or fragment thereof); a recombinant protein, e.g., fusion protein, that binds to CD20; inhibitory nucleic acid; or a cell expressing a CD20 CAR, e.g., a CD20 CAR-expressing T cell or NK cell. In one embodiment, the CD20 inhibitor is an anti-CD20 CAR expressing cell, e.g., CD20 CART or CD20 CAR-expressing NK cell. Exemplary CD20 inhibitors are described in more detail below.

In an embodiment, the present disclosure provides a population of CAR-expressing cells, e.g., CART cells or CAR-expressing NK cells, comprising a mixture of cells expressing CD20 CARs. For example, in one embodiment, the population of CAR-expressing cells includes a first cell expressing a CD20 CAR and a second cell expressing a CD19 CAR.

In one embodiment, the second CD20 inhibitor is an anti-CD20 antibody or fragment thereof. In an embodiment, the antibody is a monospecific antibody, and in another embodiment, the antibody is a bispecific antibody. In an embodiment, the CD20 inhibitor is a chimeric mouse/human monoclonal antibody, e.g., rituximab. In an embodiment, the CD20 inhibitor is a human monoclonal antibody such as ofatumumab. In an embodiment, the CD20 inhibitor is a humanized antibody such as ocrelizumab, veltuzumab, obinutuzumab, ocaratuzumab, or PRO131921 (Genentech). In an embodiment, the CD20 inhibitor is a fusion protein comprising a portion of an anti-CD20 antibody, such as TRU-015 (Trubion Pharmaceuticals).

For example, the anti-CD20 antibody is chosen from rituximab, ofatumumab, ocrelizumab, veltuzumab, obinutuzumab, TRU-015 (Trubion Pharmaceuticals), ocaratuzumab, or Pro131921 (Genentech). See, e.g., Lim et al. Haematologica. 95.1(2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in www.accessdata.fda.gov/drugsatfda_docs/label/2010/103705s53111b1.pdf.

In some embodiments, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NS0). See, e.g., www.accessdata.fda.gov/drugsatfda_docs/label/2009/1253261b1.pdf; and Clinical Trial Identifier number NCT01363128, NCT01515176, NCT01626352, and NCT01397591.

In some embodiments, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378(2011):1779-87. In some embodiments, ocrelizumab is administered as an intravenous infusion.

In some embodiments, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al. Leuk Lymphoma. 51(5)(2010):747-55. In some embodiments, veltuzumab is administered subcutaneously or intravenously, e.g., as an intravenous infusion.

In some embodiments, the anti-CD20 antibody comprises GA101. GA101 (also called obinutuzumab or RO5072759) is a humanized and glyco-engineered anti-CD20 monoclonal antibody. See, e.g., Robak. Curr. Opin. Investig. Drugs. 10.6(2009):588-96; Clinical Trial Identifier Numbers: NCT01995669, NCT01889797, NCT02229422, and NCT01414205; and www.accessdata.fda.gov/drugsatfda_docs/label/2013/125486s0001b1.pdf. In some embodiments, GA101 is administered intravenously, e.g., as an intravenous infusion.

In some embodiments, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1(2011):13-25; and Forero-Torres et al. Clin Cancer Res. 18.5(2012):1395-403.

In some embodiments, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1(2011):13-25; and Casulo et al. Clin Immunol. 154.1(2014):37-46; Clinical Trial Identifier No. NCT00452127. In some embodiments, PRO131921 is administered intravenously, e.g., as an intravenous infusion.

In some embodiments, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1 (2011):13-25. TRU-015 contains an anti-CD20 single-chain variable fragment (scFv) linked to human IgG1 hinge, CH2, and CH3 domains but lacks CH1 and CL domains. In some cases, TRU-015 is administered intravenously, e.g., as an intravenous infusion.

In some embodiments, an anti-CD20 antibody described herein is conjugated or otherwise bound to a therapeutic agent, e.g., a chemotherapeutic agent (e.g., a chemotherapeutic agent described herein, e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent, CD20 antibody, or CD20 antibody drug conjugate described herein), anti-allergic agent, anti-nausea agent (or anti-emetic), pain reliever, or cytoprotective agent described herein.

In one embodiment, the CD20 inhibitor includes a CD20 CAR-expressing cell, e.g., a CD20 CART, or e.g., a CD20-CAR that comprises a CD20 binding domain and is engineered into a cell (e.g., T cell or NK cell) for administration in combination with CD19 CART, and methods of their use for adoptive therapy. In some embodiments, the CD20 inhibitor includes a cell expressing a CD20 CAR construct or encoded by a CD20 CAR comprising a scFv, CDRs, or VH and VL chains. For example, a CD20 CAR-expressing cell, e.g., CART, is generated by engineering a CD20-CAR (that comprises a CD20 binding domain) into a cell (e.g., a T cell or NK cell), e.g., for administration in combination with a CAR-expressing cell described herein, e.g., a CD20 CART described herein.

In another aspect, the present invention provides a population of CAR-expressing cells, e.g., CAR-expressing cell, comprising a mixture of cells expressing CD20 CARs and CD19 CARs. For example, in one embodiment, the population of CAR-expressing cell can include a first cell expressing a CD20 CAR and a second cell expressing a CD19 CAR. In one embodiment, the population of CAR-expressing cells includes, e.g., a first cell expressing a CAR (e.g., a CD20 CAR or CD19 CAR) that includes a primary intracellular signaling domain, and a second cell expressing a CAR (e.g., a CD20 CAR or CD19 CAR) that includes a secondary signaling domain.

CD19 Inhibitors

Provided herein are CD19 inhibitors and combination therapies, e.g., one or more CD19 inhibitors. In some embodiments, the methods and compositions (e.g., CD19 CAR-expressing cells) described herein further include a second CD19 inhibitor. For example, a CD19 CAR-expressing cell described herein is administered in combination with a second CD19 inhibitor. A CD19 inhibitor includes but is not limited to a CD19 CAR-expressing cell, e.g., a CD19

CART cell, a CD19 CAR-expressing NK cell, or an anti-CD19 antibody (e.g., an anti-CD19 mono- or bispecific antibody) or a fragment thereof.

Exemplary anti-CD19 antibodies or fragments or conjugates thereof include but are not limited to blinatumomab, SAR3419 (Sanofi), MEDI-551 (MedImmune LLC), Combotox, DT2219ARL (Masonic Cancer Center), MOR-208 (also called XmAb-5574; MorphoSys), XmAb-5871 (Xencor), MDX-1342 (Bristol-Myers Squibb), SGN-CD19A (Seattle Genetics), and AFM11 (Affimed Therapeutics). See, e.g., Hammer. MAbs. 4.5(2012): 571-77.

In some embodiments, the anti-CD19 antibody or fragment or conjugate thereof comprises blinatomomab. Blinatomomab is a bispecific antibody comprised of two scFvs—one that binds to CD19 and one that binds to CD3. Blinatomomab directs T cells to attack cancer cells. See, e.g., Hammer et al.; Clinical Trial Identifier No. NCT00274742 and NCT01209286. In some embodiments, blinatomomab can be used to treat NHL (e.g., DLBCL) or ALL.

In some embodiments, the anti-CD19 antibody comprises MEDI-551. MEDI-551 is a humanized anti-CD19 antibody with a Fc engineered to have enhanced antibody-dependent cell-mediated cytotoxicity (ADCC). See, e.g., Hammer et al.; and Clinical Trial Identifier No. NCT01957579. In some embodiments, MEDI-551 can be used to treat B cell malignancies (e.g., NHL, CLL, DLBCL, and multiple myeloma), multiple sclerosis, and scleroderma.

In some embodiments, the anti-CD19 antibody or fragment or conjugate thereof comprises Combotox. Combotox is a mixture of immunotoxins that bind to CD19 and CD22. The immunotoxins are made up of scFv antibody fragments fused to a deglycosylated ricin A chain. See, e.g., Hammer et al.; and Herrera et al. J. Pediatr. Hematol. Oncol. 31.12 (2009):936-41; Schindler et al. Br. J. Haematol. 154.4 (2011):471-6. In some embodiments, Combotox can be used to treat B cell leukemia, e.g., ALL.

In some embodiments, the anti-CD19 antibody or fragment or conjugate thereof comprises DT2219ARL. DT2219ARL is a bispecific immunotoxin targeting CD19 and CD22, comprising two scFvs and a truncated diphtheria toxin. See, e.g., Hammer et al.; and Clinical Trial Identifier No. NCT00889408. In some embodiments, DT2219ARL can be used to treat B cell malignancies, e.g., B cell leukemias and lymphomas.

In some embodiments, DT2219ARL is administered intravenously, e.g., as an intravenous infusion.

In some embodiments, the anti-CD19 antibody or fragment or conjugate thereof comprises SGN-CD19A. SGN-CD19A is an antibody-drug conjugate (ADC) comprised of an anti-CD19 humanized monoclonal antibody linked to a synthetic cytotoxic cell-killing agent, monomethyl auristatin F (MMAF). See, e.g., Hammer et al.; and Clinical Trial Identifier Nos. NCT01786096 and NCT01786135. In some embodiments, SGN-CD19A can be used to treat B-cell ALL, NHL (e.g., DLBCL, mantle cell lymphoma, or follicular lymphoma), Burkitt lymphoma or leukemia, or B-lineage lymphoblastic lymphoma (B-LBL). In some embodiments, SGN-CD19A is administered intravenously, e.g., as an intravenous infusion.

In some embodiments, the anti-CD19 antibody comprises MOR-208 (also called XmAb-5574). MOR-208 is an Fc-engineered anti-CD19 humanized monoclonal antibody with enhanced FcγRIIIA binding, which results in improved ADCC activity. See, e.g., ClinicalTrials.gov Identifier Nos. NCT01685008, NCT01685021, NCT02005289, and NCT01161511; Hammer et al.; Woyach et al. Blood 124.24 (2014).

In some embodiments, MOR-208 can be used to treat NHL (e.g., FL, MCL, DLBCL), CLL, small lymphocytic lymphoma, prolymphocytic leukemia, or B-cell Acute Lymphoblastic Leukemia (B-ALL). In some embodiments, MOR-208 is administered intravenously, e.g., as an intravenous infusion.

In some aspect, the anti-CD19 antibody or fragment or conjugate thereof comprises SAR3419. SAR3419 is an anti-CD19 antibody-drug conjugate (ADC) comprising an anti-CD19 humanized monoclonal antibody conjugated to a maytansine derivative via a cleavable linker. See. e.g. Y Dunes et al. J. Clin. Oncol. 30.2(2012): 2776-82; Hammer et al.; Clinical Trial Identifier No. NCT00549185; and Blanc et al. Clin Cancer Res. 2011; 17:6448-58. In some embodiments, SAR3419 can be used to treat NHL (diffuse large B-cell lymphoma (DLBCL) and follicular small cleaved cell lymphoma) or B-cell ALL.

In some embodiments, the anti-CD19 antibody comprises XmAb-5871. XmAb-5871 is an Fc-engineered, humanized anti-CD19 antibody. In some embodiments, XmAb-5871 can be used to treat autoimmune diseases, such as lupus. See, e.g., Hammer et al.

In some embodiments, the anti-CD19 antibody comprises MDX-1342, which is a human Fc-engineered anti-CD19 antibody with enhanced ADCC. In some embodiments, MDX-1342 can be used to treat CLL and rheumatoid arthritis. See, e.g., Hammer et al.

In some embodiments, the anti-CD19 antibody comprises AFM11. AFM11 is a bispecific antibody that targets CD19 and CD3. In some embodiments, AFM11 can be used to treat NHL (e.g., DLBCL), ALL, or CLL. See, e.g., Hammer et al.; and Clinical Trial Identifier No. NCT02106091. In some embodiments, AFM11 is administered as an intravenous infusion.

In some embodiments, an anti-CD19 antibody described herein is conjugated or otherwise bound to a therapeutic agent, e.g., a chemotherapeutic agent (e.g., a chemotherapeutic agent described herein), peptide vaccine (such as that described in Izumoto et al. 2008 J Neurosurg 108:963-971), immunosuppressive agent (e.g., an immunosuppressive agent described herein), or immunoablative agent (e.g., an immunoablative agent described herein), e.g., cyclosporin, azathioprine, methotrexate, mycophenolate, FK506, CAMPATH, anti-CD3 antibody, cytoxin, fludarabine, rapamycin, mycophenolic acid, steroid, FR901228, or cytokine.

In some embodiments, a CD19 inhibitor includes an anti-CD19 CAR-expressing cell, e.g., CART, e.g., a cell expressing an anti-CD19 CAR construct. In an embodiment, the anti-CD19 CAR construct comprises a murine scFv sequence. For example, the anti-CD19 CAR construct comprising a murine scFv sequence is the CAR19 construct provided in PCT publication WO2012/079000 and provided herein.

For example, an anti-CD19 CAR-expressing cell, e.g., CART, is a generated by engineering a CD19-CAR (that comprises a CD19 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CAR-expressing cell, comprising a mixture of cells expressing CD22 CARs and CD19 CARs. For example, in one embodiment, the population of CAR-expressing cell can include a first cell expressing a CD22 CAR and a second cell expressing a CD19 CAR.

CD123 Inhibitors

Provided herein are CD123 inhibitors and combination therapies. CD123 inhibitors include but are not limited to small molecules, recombinant proteins, anti-CD123 CAR-expressing cells, e.g. CARTs, and anti-CD123 antibodies (e.g., an anti-CD123 mono- or bispecific antibody) and fragments thereof. In some embodiments, anti-CD123 inhibitors can be used to treat a B-cell malignancy described herein. In an embodiment, the CD123 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In one embodiment, the CD123 inhibitor is a recombinant protein, e.g., comprising the natural ligand (or a fragment) of the CD123 receptor. For example, the recombinant protein is SL-401 (also called DT3881L3; University of Texas Southwestern Medical Center), which is a fusion protein comprising human IL-3 fused to a truncated diphtheria toxin. See, e.g., Testa et al. Biomark Res. 2014; 2: 4; and Clinical Trial Identifier No. NCT00397579.

In another embodiment, the CD123 inhibitor is an anti-CD123 antibody or fragment thereof. In one embodiment, the anti-CD123 antibody or fragment thereof comprises a monoclonal antibody, e.g., a monospecific or bispecific antibody or fragment thereof. For example, the anti-CD123 antibody or fragment thereof comprises CSL360 (CSL Limited). CSL360 is a recombinant chimeric monoclonal antibody that binds to CD123. In some embodiments, CSL360 is administered intravenously, e.g., by intravenous infusion. See, e.g., Clinical Trial Identifier No. NCT01632852; and Testa et al.

In another embodiment, the CD123 antibody or fragment thereof comprises CSL362 (CSL Limited). CSL362 is a humanized monoclonal antibody that targets the CD123 and is optimized for enhanced activation of antibody dependent cell-mediated cytotoxicity (ADCC). In some embodiments, CSL362 is administered intravenously, e.g., by intravenous infusion. See, e.g., Clinical Trial Identifier No. NCT01632852.

In one embodiment, the CD123 antibody or fragment thereof comprises a bispecific antibody, e.g., MGD006 (MacroGenics). MGD006 is a bispecific antibody that targets CD123 and CD3. See, e.g., Clinical Trial Identifier No. NCT02152956.

In some embodiments, the CD123 inhibitor is conjugated or otherwise bound to a therapeutic agent.

In some embodiments, a CD123 inhibitor includes an anti-CD123 CAR-expressing cell, e.g., CART, e.g., a cell expressing an anti-CD123 CAR construct or encoded by a CD123 binding CAR comprising a scFv, CDRs, or VH and VL chains. For example, an anti-CD123 CAR-expressing cell, e.g., CART is generated by engineering a CD123-CAR (that comprises a CD123 binding domain) into a cell (e.g., a T cell or NK cell), e.g., for administration in combination with a CAR-expressing cell described herein. In an embodiment, the anti-CD123 CAR construct comprises a scFv sequence, e.g., a scFv sequence provided in US 2014/0322212 A1, incorporated herein by reference. In one embodiment, the anti-CD123 binding domain is a scFv described in US 2014/0322212 A1. In an embodiment, the anti-CD123 binding domain is part of a CAR construct provided in US 2014/0322212 A1. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD123 CARs. For example, in one embodiment, the population of CAR-expressing cellscan include a first cell expressing a CD19 CAR and a second cell expressing a CD123 CAR.

CD10 Inhibitors

Also provided herein are CD10 inhibitors and combination therapies. CD10 inhibitors include but are not limited to small molecules, recombinant proteins, anti-CD10 CAR-expressing cells, e.g. CARTs, and anti-CD10 antibodies (e.g., an anti-CD10 mono- or bispecific antibody) and fragments thereof. In some embodiments, anti-CD10 inhibitors can be used to treat a B-cell malignancy described herein. In an embodiment, the CD10 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD10 inhibitor comprises a small molecule, such as sacubitril (Novartis), valsartan/sacubritril (Novartis), omapatrilat (Bristol-Myers Squibb), RB-101, UK-414,495 (Pfizer), or a pharmaceutically acceptable salt or a derivative thereof.

In an embodiment, the CD10 inhibitor comprises sacubitril (AHU-377; Novartis) (4-{[(2S,4R)-1-(4-Biphenylyl)-5-ethoxy-4-methyl-5-oxo-2-pentanyl]amino}-4-oxobutanoic acid), or a pharmaceutically acceptable salt or a derivative thereof.

In another embodiment, the CD10 inhibitor comprises valsartan/sacubritril (LCZ696; Novartis) or a pharmaceutically acceptable salt or a derivative thereof. Valsartan/sacubritril is a combination drug comprising a 1:1 mixture of valsartan and sacubitril. The structure of Valsartan has the following chemical name: ((S)-3-methyl-2-(N-{[2'-(2H-1,2,3,4-tetrazol-5-yl)biphenyl-4-yl]methyl}pentanamido)butanoic acid).

In an embodiment, the CD10 inhibitor comprises omapatrilat (Bristol-Myers Squibb) ((4S,7S,10aS)-5-oxo-4-{[(2S)-3-phenyl-2-sulfanylpropanoyl]amino}-2,3,4,7,8,9,10,10a-octahydropyrido[6,1-b][1,3]thiazepine-7-carboxylic acid), or a pharmaceutically acceptable salt or a derivative thereof.

In an embodiment, the CD10 inhibitor comprises RB-101 (benzyl N-(3-{[(2S)-2-amino-4-(methylthio)butyl]dithio}-2-benzylpropanoyl)-L-phenylalaninate), or a pharmaceutically acceptable salt or a derivative thereof.

In an embodiment, the CD10 inhibitor comprises UK-414,495 (Pfizer) ((R)-2-({1-[(5-ethyl-1,3,4-thiadiazol-2-yl)carbamoyl]cyclopentyl}methyl)valeric acid), or a pharmaceutically acceptable salt or a derivative thereof.

In some embodiments, the CD10 inhibitor is conjugated or otherwise bound to a therapeutic agent.

In some embodiments, a CD10 inhibitor includes an anti-CD10 CAR-expressing cell, e.g., CART, e.g., a cell expressing an anti-CD10 CAR construct or encoded by a CD10 binding CAR comprising a scFv, CDRs, or VH and VL chains. For example, an anti-CD10 CAR-expressing cell, e.g., CART is a generated by engineering a CD10-CAR (that comprises a CD10 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD10 CARs. For example, in one embodiment, the population of CAR-expressing cells can include a first cell expressing a CD19 CAR and a second cell expressing a CD10 CAR.

CD34 Inhibitors

Also provided herein are CD34 inhibitors and combination therapies. CD34 inhibitors include but are not limited to small molecules, recombinant proteins, anti-CD34 CAR-expressing cells, e.g. CARTs, and anti-CD34 antibodies (e.g., an anti-CD34 mono- or bispecific antibody) and fragments thereof. In some embodiments, anti-CD34 inhibitors can be used to treat a B-cell malignancy described herein. In an embodiment, the CD34 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD34 inhibitor comprises a monoclonal antibody or fragment thereof that targets CD34 or an immunoliposome comprising an anti-CD34 monoclonal antibody or fragment thereof.

In an embodiment, the CD34 inhibitor comprises an antibody or fragment thereof, e.g., the My-10 monoclonal antibody or an immunoliposome comprising the My-10 monoclonal antibody, as described in Mercadal et al. Biochim. Biophys. Acta. 1371.1(1998):17-23. In other embodiments, the CD34 inhibitor comprises an immunoliposome containing a cancer drug, e.g., doxorubicin, that is targeted to CD34-expressing cells, as described in Carrion et al. Life Sci. 75.3(2004):313-28. In an embodiment, the CD34 inhibitor comprises a monoclonal antibody against CD34 as described in Maleki et al. Hum. Antibodies. 22(2013):1-8. In another embodiment, the CD34 inhibitor comprises a monoclonal antibody that targets CD34, as described in Maleki et al. Cell J. 16.3(2014):361-66.

In some embodiments, the CD34 inhibitor is conjugated or otherwise bound to a therapeutic agent.

In some embodiments, a CD34 inhibitor includes an anti-CD34 CAR-expressing cell, e.g., CART, e.g., a cell expressing an anti-CD34 CAR construct or encoded by a CD34 binding CAR comprising a scFv, CDRs, or VH and VL chains. For example, an anti-CD34 CAR-expressing cell, e.g., CART is a generated by engineering a CD34-CAR (that comprises a CD34 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD34 CARs. For example, in one embodiment, the population of CAR-expressing cells can include a first cell expressing a CD19CAR and a second cell expressing a CD34 CAR.

FLT-3 Inhibitors

Fms-like tyrosine kinase 3 (FLT-3), also called Cluster of differentiation antigen 135 (CD135), receptor-type tyrosine-protein kinase FLT3, or fetal liver kinase-2 (Flk2), is a receptor tyrosine kinase. FLT-3 is a cytokine receptor for the ligand, cytokine Flt3 ligand (FLT3L). FLT-3 is expressed on the surface of many hematopoietic progenitor cells and is important for lymphocyte development. The FLT3 gene is commonly mutated in leukemia, e.g., acute myeloid leukemia (AML).

Also provided herein are FLT-3 inhibitors and combination therapies. FLT-3 inhibitors include but are not limited to small molecules, recombinant proteins, anti-FLT-3 CAR-expressing cells, e.g. CARTs, and anti-FLT-3 antibodies (e.g., an anti-FLT-3 mono- or bispecific antibody) and fragments thereof. In some embodiments, anti-FLT-3 inhibitors can be used to treat a B-cell malignancy described herein. In an embodiment, the FLT-3 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In some embodiments, the FLT-3 inhibitor comprises a small molecule, such as quizartinib (Ambit Biosciences), midostaurin (Technische Universitat Dresden), sorafenib (Bayer and Onyx Pharmaceuticals), sunitinib (Pfizer), lestaurtinib (Cephalon), or a pharmaceutically acceptable salt or derivative thereof.

In some embodiments, the FLT-3 inhibitor comprises quizartinib (AC220; Ambit Biosciences) or a pharmaceutically acceptable salt or a derivative thereof. Quizartinib is a small molecule receptor tyrosine kinase inhibitor. Quizartinib has the following chemical name: (1-(5-(tert-Butyl) isoxazol-3-yl)-3-(4-(7-(2-morpholinoethoxy)benzo[d]imidazo[2,1-b]thiazol-2-yl)phenyl)urea).

In some embodiments, the FLT-3 inhibitor comprises midostaurin is (PKC412; Technische Universitat Dresden) or a pharmaceutically acceptable salt or a derivative thereof. Midostaurin is a protein kinase inhibitor that is a semi-synthetic derivative of staurosporine, an alkaloid from the bacterium *Streptomyces* staurosporeus. The chemical name of midostaurin is as follows: ((9S,10R,11R,13R)-2,3,10,11, 12,13-Hexahydro-10-methoxy-9-methyl-11-(methyl-amino)-9,13-epoxy-1H,9H-diindolo[1,2,3-gh:3',2',1'-1m] pyrrolo[3,4-j][1,7]benzodiamzonine-1-one).

In an embodiment, the FLT-3 inhibitor comprises sorafenib (Bayer and Onyx Pharmaceuticals) or a pharmaceutically acceptable salt or a derivative thereof. See, e.g., labeling.bayerhealthcare.com/html/products/pi/Nexavar_PI.pdf. The chemical name of sorafenib is (4-[4-[[4-chloro-3-(trifluoromethyl)phenyl]carbamoylamino]phenoxy]-N-methyl-pyridine-2-carboxamide).

In some embodiments, the FLT-3 inhibitor comprises sunitinib (previously known as SU11248; Pfizer) or a pharmaceutically acceptable salt or derivative thereof. Sunitinib has the following chemical name: (N-(2-diethylaminoethyl)-5-[(Z)-(5-fluoro-2-oxo-1H-indol-3-ylidene)methyl]-2,4-dimethyl-1H-pyrrole-3-carboxamide).

In some embodiments, the FLT-3 inhibitor comprises lestaurtinib (CEP-701; Cephalon) or a pharmaceutically acceptable salt or derivative thereof. Lestaurtinib has the following chemical name: ((9S,10S,12R)-2,3,9,10,11,12-Hexahydro-10-hydroxy-10-(hydroxymethyl)-9-methyl-9, 12-epoxy-1H-diindolo[1,2,3-fg:3',2',1'-kl]-Mpyrrolo[3,4-i] [1,6]benzodiazocin-1-one).

In some embodiments, a FLT-3 inhibitor includes an anti-FLT-3 CAR-expressing cell, e.g., CART, e.g., a cell expressing an anti-FLT-3 CAR construct or encoded by a FLT-3 binding CAR comprising a scFv, CDRs, or VH and VL chains. For example, an anti-FLT-3 CAR-expressing cell, e.g., CART is a generated by engineering a FLT-3-CAR (that comprises a FLT-3 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and FLT-3 CARs. For example, in one embodiment, the population of CAR-expressing cells can include a first cell expressing a CD19 CAR and a second cell expressing a FLT-3 CAR.

CD79b Inhibitors

Provided herein are CD79b inhibitors and combination therapies. CD79b inhibitors include but are not limited to small molecules, recombinant proteins, anti-CD79b CAR-expressing cells, e.g. CARTs, and anti-CD79b antibodies (e.g., an anti-CD79b mono- or bispecific antibody) and fragments thereof. In some embodiments, anti-CD79b inhibitors can be used to treat a B-cell malignancy described herein. In an embodiment, the CD79b inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD79b inhibitor is an anti-CD79b antibody or fragment thereof. In one embodiment, the anti-79b antibody or fragment thereof comprises a monoclonal antibody, e.g., a monospecific or bispecific antibody or fragment thereof. For example, the anti-CD79b antibody or fragment thereof comprises polatuzuinab vedotin (Roche), an anti-CD79 antibody drug conjugate. In embodiments, polatuzumab vedotin is used to treat a cancer, e.g., NHL e.g., follicular lymphoma or DLBCL, e.g., relapsed or refractory follicular lymphoma or DLBCL. See, e.g., NCT02257567. In embodiments, the anti-CD79b antibody or fragment thereof comprises MGD010 (MacroGenics), which is a bispecific antibody comprising components that bind to CD32B and D79B. See, e.g., NCT02376036.

In some embodiments, the CD79b inhibitor is conjugated or otherwise bound to a therapeutic agent.

In some embodiments, a CD79b inhibitor includes an anti-CD79b CAR-expressing cell, e.g., CART, e.g., a cell expressing an anti-CD79b CAR construct or encoded by a CD79b binding CAR comprising a scFv, CDRs, or VH and VL chains. For example, an anti-CD79b CAR-expressing cell, e.g., CART is a generated by engineering a CD79b-CAR (that comprises a CD79b binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD79b CARs. For example, in one embodiment, the population of CAR-expressing cells can include a first cell expressing a CD19 CAR and a second cell expressing a CD79b CAR.

CD79a Inhibitors

Provided herein are CD79a inhibitors and combination therapies. CD79a inhibitors include but are not limited to small molecules, recombinant proteins, anti-CD79a CAR-expressing cells, e.g. CARTs, and anti-CD79a antibodies (e.g., an anti-CD79a mono- or bispecific antibody) and fragments thereof. In some embodiments, anti-CD79a inhibitors can be used to treat a B-cell malignancy described herein. In an embodiment, the CD79a inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD79a inhibitor is an anti-CD79a antibody or fragment thereof. In one embodiment, the anti-CD79a antibody or fragment thereof comprises a monoclonal antibody, e.g., a monospecific or bispecific antibody or fragment thereof. For example, the anti-CD79a antibody or fragment thereof comprises an anti-CD79a antibody or fragment thereof described in Poison et al. Blood 110.2 (2007):616-23, incorporated herein by reference. For example, the anti-CD79a antibody or fragment thereof comprises the 7H7, 15E4, or 16C11 antibody or fragment thereof described in Polson et al. See Id.

In some embodiments, the CD79a inhibitor is conjugated or otherwise bound to a therapeutic agent.

In some embodiments, a CD79a inhibitor includes an anti-CD79a CAR-expressing cell, e.g., CART, e.g., a cell expressing an anti-CD79a CAR construct or encoded by a CD79a binding CAR comprising a scFv, CDRs, or VH and VL chains. For example, an anti-CD79a CAR-expressing cell, e.g., CART is a generated by engineering a CD79a-CAR (that comprises a CD79a binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD79a CARs. For example, in one embodiment, the population of CAR-expressing cells can include a first cell expressing a CD19 CAR and a second cell expressing a CD79a CAR.

CD179b Inhibitors

Provided herein are CD179b inhibitors and combination therapies. CD179b inhibitors include but are not limited to small molecules, recombinant proteins, anti-CD179b CAR-expressing cells, e.g. CARTs, and anti-CD179b antibodies (e.g., an anti-CD179b mono- or bispecific antibody) and fragments thereof.

In some embodiments, anti-CD179b inhibitors can be used to treat a B-cell malignancy described herein. In an embodiment, the CD179b inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD179b inhibitor is an anti-CD179b antibody or fragment thereof. In one embodiment, the anti-179b antibody or fragment thereof comprises a monoclonal antibody, e.g., a monospecific or bispecific antibody or fragment thereof.

In some embodiments, the CD179b inhibitor is conjugated or otherwise bound to a therapeutic agent.

In some embodiments, a CD179b inhibitor includes an anti-CD179b CAR-expressing cell, e.g., CART, e.g., a cell expressing an anti-CD179b CAR construct or encoded by a CD179b binding CAR comprising a scFv, CDRs, or VH and VL chains. For example, an anti-CD179b CAR-expressing cell, e.g., CART is a generated by engineering a CD179b-CAR (that comprises a CD179b binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD179b CARs. For example, in one embodiment, the population of CAR-expressing cells can include a first cell expressing a CD19 CAR and a second cell expressing a CD179b CAR.

CD22 Inhibitors

Provided herein are CD22 inhibitors and combination therapies. CD22 inhibitors include but are not limited to small molecules, recombinant proteins, anti-CD22 CAR-expressing cells, e.g. CARTs, and anti-CD22 antibodies (e.g., an anti-CD22 mono- or bispecific antibody) and fragments thereof. In some embodiments, anti-CD22 inhibitors can be used to treat a B-cell malignancy described herein. In an embodiment, the CD22 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In one embodiment, the CD22 inhibitor is a CD22 inhibitor described herein. The CD22 inhibitor can be, e.g., an anti-CD22 antibody (e.g., an anti-CD22 mono- or bispecific antibody) or a CD22 CART. In some embodiments the anti-CD22 antibody is conjugated or otherwise bound to a therapeutic agent. Exemplary therapeutic agents include, e.g., microtubule disrupting agents (e.g., monomethyl auristatin E) and toxins (e.g., diphtheria toxin or *Pseudomonas* exotoxin-A, ricin).

In an embodiment, the anti-CD22 antibody is an anti-CD22 monoclonal antibody-MMAE conjugate (e.g., DCDT2980S). In an embodiment, the antibody is a scFv of an anti-CD22 antibody, e.g., a scFv of antibody RFB4. This scFv can be fused to all of or a fragment of *Pseudomonas* exotoxin-A (e.g., BL22). In an embodiment, the antibody is a humanized anti-CD22 monoclonal antibody (e.g., epratuzumab). In an embodiment, the antibody or fragment thereof comprises the Fv portion of an anti-CD22 antibody, which is optionally covalently fused to all or a fragment or (e.g., a 38 KDa fragment of) *Pseudomonas* exotoxin-A (e.g., moxetumomab pasudotox). In an embodiment, the anti-CD22 antibody is an anti-CD19/CD22 bispecific antibody, optionally conjugated to a toxin. For instance, in one embodiment, the anti-CD22 antibody comprises an anti-CD19/CD22 bispecific portion, (e.g., two scFv ligands, recognizing human CD19 and CD22) optionally linked to all of or a portion of diphtheria toxin (DT), e.g., first 389 amino acids of diphtheria toxin (DT), DT 390, e.g., a ligand-directed toxin such as DT2219ARL). In another embodiment, the bispecific portion (e.g., anti-CD19/anti-CD22) is linked to a toxin such as deglycosylated ricin A chain (e.g., Combotox).

In one embodiment, the anti-CD22 antibody is selected from an anti-CD19/CD22 bispecific ligand-directed toxin (e.g., two scFv ligands, recognizing human CD19 and CD22, linked to the first 389 amino acids of diphtheria toxin (DT), DT 390, e.g., DT2219ARL); anti-CD22 monoclonal antibody-MMAE conjugate (e.g., DCDT2980S); scFv of an anti-CD22 antibody RFB4 fused to a fragment of *Pseudomonas* exotoxin-A (e.g., BL22); deglycosylated ricin A chain-conjugated anti-CD19/anti-CD22 (e.g., Combotox); humanized anti-CD22 monoclonal antibody (e.g., epratuzumab); or the Fv portion of an anti-CD22 antibody covalently fused to a 38 KDa fragment of *Pseudomonas* exotoxin-A (e.g., moxetumomab pasudotox).

In some embodiments, the present disclosure encompasses a recombinant nucleic acid construct comprising a nucleic acid molecule encoding a CAR (e.g., a CD19 CAR, a ROR1 CAR, a CD20 CAR, a CD22 CAR, a CD123 CAR, a CD10 CAR, a CD34 CAR, or a FLT-3 CAR), wherein the nucleic acid molecule comprises the nucleic acid sequence encoding an antigen binding domain, e.g., described herein, e.g., that is contiguous with and in the same reading frame as a nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like.

In one embodiment, the antigen binding domain (e.g., a CD19, ROR1, CD20, CD22, CD123, CD10, CD34, or FLT-3 antigen binding domain) is characterized by particular functional features or properties of an antibody or antibody fragment. For example, in one embodiment, the portion of a CAR composition of the invention that comprises an antigen binding domain specifically binds a human B-cell antigen (e.g., CD19, ROR1, CD20, CD22, CD123, CD10, CD34, or FLT-3) or a fragment thereof. In certain embodiments, the scFv is contiguous with and in the same reading frame as a leader sequence. In one aspect the leader sequence is the polypeptide sequence provided as SEQ ID NO:1.

In one embodiment, the antigen binding domain is a fragment, e.g., a single chain variable fragment (scFv). In one embodiments, the antigen binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a B-cell protein or a fragment thereof with wild-type or enhanced affinity. In some instances, a human scFv can be derived from a display library.

In one embodiment, the antigen binding domain, e.g., scFv comprises at least one mutation such that the mutated scFv confers improved stability to the CAR construct. In another embodiment, the antigen binding domain, e.g., scFv comprises at least 1, 2, 3, 4, 5, 6, 7, 8, 9, 10 mutations arising from, e.g., the humanization process such that the mutated scFv confers improved stability to the CAR construct.

In one embodiment, the population of CAR-expressing cells includes, e.g., a first cell expressing a CAR (e.g., a CD19 CAR, a ROR1 CAR, a CD20 CAR, a CD22 CAR, a CD123 CAR, a CD10 CAR, a CD34 CAR, or a FLT-3 CAR) that includes a primary intracellular signaling domain, and a second cell expressing a CAR (e.g., a CD19 CAR, a ROR1 CAR, a CD20 CAR, a CD22 CAR, a CD123 CAR, a CD10 CAR, a CD34 CAR, or a FLT-3 CAR)) that includes a secondary signaling domain.

Kinase Inhibitor

In one embodiment, a CAR-expressing cell described herein may be used in a treatment regimen in combination with a kinase inhibitor, e.g., a CDK4 inhibitor, a BTK inhibitor, an MNK inhibitor, an mTOR inhibitor, an ITK inhibitor, etc. In one embodiment, the subject is a complete responder, and the subject is administered a treatment regimen that includes administration of a CAR-expressing cell described herein in combination with a kinase inhibitor, e.g., a kinase inhibitor described herein, e.g., at a dose or dosing schedule described herein. In one embodiment, the subject is a partial responder or a non-responder, and the subject is administered a treatment regimen that includes administration of a CAR-expressing cell described herein in combination with a kinase inhibitor, e.g., a kinase inhibitor described herein, e.g., at a dose or dosing schedule described herein.

In an embodiment, the kinase inhibitor is a CDK4 inhibitor, e.g., a CDK4 inhibitor described herein, e.g., a CDK4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor.

In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment, the kinase inhibitor is an mTOR inhibitor selected from temsirolimus; ridaforolimus (1R,2R,4S)-4-[(2R)-2[(1R,9S,12S,15R,16E,18R,19R,21R,23S,24E,26E,28Z,30S,32S,35R)-1,18-dihydroxy-19,30-dimethoxy-15,17,21,23, 29,35-hexamethyl-2,3,10,14,20-pentaoxo-11,36-dioxa-4-azatricyclo[30.3.1.0$^{4,9}$]hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl] pyrido[2,3-d]pyrimidin-7-yl}-2-methoxyphenyl)methanol (AZD8055); 2-mmino-8-[trans-4-(2-hydroxyethoxy)cyclohexyl]-6-(6-methoxy-3-pyridinyl)-4-methyl-pyrido[2,3-d] pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-, inner salt (SF1126) (SEQ ID NO: 140); and XL765.

In one embodiment, the kinase inhibitor is an MNK inhibitor selected from CGP052088; 4-amino-3-(p-fluorophenylamino)-pyrazolo[3,4-d]pyrimidine (CGP57380); cercosporamide; ETC-1780445-2; and 4-amino-5-(4-fluoroanilino)-pyrazolo[3,4-d]pyrimidine.

Combination with a Low Dose of an mTOR Inhibitor

In one embodiment, the cells expressing a CAR molecule, e.g., a CAR molecule described herein, are administered in combination with a low, immune enhancing dose of an mTOR inhibitor.

In an embodiment, a dose of an mTOR inhibitor is associated with, or provides, mTOR inhibition of at least 5 but no more than 90%, 80%, 70%, 60%, 50%, 40%, or 30%; at least 10 but no more than 90%, 80%, 70%, 60%, 50%, 40%, or 30%; at least 15, but no more than 90%, 80%, 70%, 60%, 50%, 40%, or 30%; at least 20 but no more than 90%, 80%, 70%, 60%, 50%, 40%, or 30%; at least 30 but no more than 90%, 80%, 70%, 60%, 50%, or 40%; at least 40 but no more than 90%, 80%, 70%, 60%, 50%, 40%, or 30%; at least 50 but no more than 90%, 80%, 70%, or 60%; at least 60 but no more than 90%, 80% or 70%; or at least 70 but no more than 90% or 80%.

In an embodiment, a dose of an mTOR inhibitor is associated with, or provides, mTOR inhibition of at least 5 but no more than 30%, at least 10 but no more than 30%, at least 15, but no more than 30%, at least 20 but no more than 30%, or at least 25 but no more than 30%.

In an embodiment, a dose of an mTOR inhibitor is associated with, or provides, mTOR inhibition of at least 1, 2, 3, 4 or 5 but no more than 20%, at least 1, 2, 3, 4 or 5 but no more than 30%, at least 1, 2, 3, 4 or 5, but no more than 35, at least 1, 2, 3, 4 or 5 but no more than 40%, or at least 1, 2, 3, 4 or 5 but no more than 45%.

In an embodiment, a dose of an mTOR inhibitor is associated with, or provides, mTOR inhibition of at least 1, 2, 3, 4 or 5 but no more than 90%.

As is discussed herein, the extent of mTOR inhibition can be expressed as the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by a method described herein, e.g. by the Boulay assay, or measurement of phosphorylated S6 levels by Western blot.

Exemplary mTOR Inhibitors

As used herein, the term "mTOR inhibitor" refers to a compound or ligand, or a pharmaceutically acceptable salt thereof, which inhibits the mTOR kinase in a cell. In an embodiment an mTOR inhibitor is an allosteric inhibitor. In an embodiment an mTOR inhibitor is a catalytic inhibitor.

Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity.

Rapamycin is a known macrolide antibiotic produced by *Streptomyces hygroscopicus* having the structure shown in Formula A.

(A)

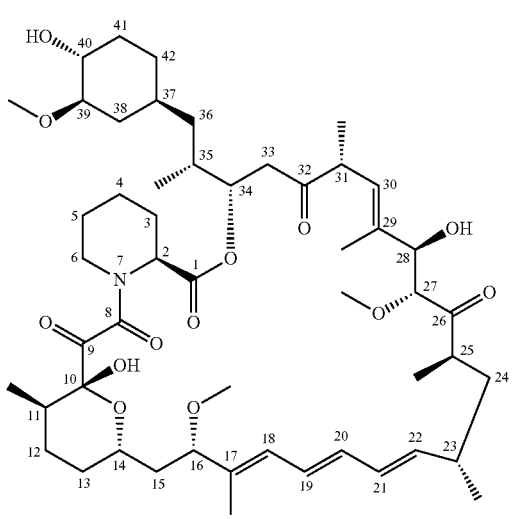

Other suitable rapamycin analogs include, but are not limited to, RAD001, otherwise known as everolimus (Afinitor®), has the chemical name (1R,9S,12S,15R,16E,18R,19R,21R,23S,24E,26E,28E,30S,32S,35R)-1,18-dihydroxy-12-{(1R)-2-[(1S,3R,4R)-4-(2-hydroxyethoxy)-3-methoxycyclohexyl]-1-methylethyl}-19,30-dimethoxy-15,17,21,23,29,35-hexamethyl-11,36-dioxa-4-aza-tricyclo[30.3.1.04,9]hexatriaconta-16,24,26,28-tetraene-2,3,10,14,20-pentaone,sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669).b Other examples of allosteric mTor inhibitors include zotarolimus (ABT578) and umirolimus as described in US2005/0101624 the contents of which are incorporated by reference. Other suitable mTOR inhibitors are described in paragraphs 946 to 964 of International Publication WO2015/142675, filed Mar. 13, 2015, which is incorporated by reference in its entirety. Low, immune enhancing doses of an mTOR inhibitor, suitable levels of mTOR inhibition associated with low doses of an mTOR inhibitor, methods for detecting the level of mTOR inhibition, and suitable pharmaceutical compositions thereof are further described in paragraphs 936 to 945 and 965 to 1003 of International Publication WO2015/142675, filed Mar. 13, 2015, which is incorporated by reference in its entirety.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Example 1: Optimizing CART Production with Exogenous Cytokines

Cytokines have important functions related to T cell expansion, differentiation, survival and homeostasis. One of the most important cytokine families for clinical use is the common γ-chain (γ$_c$) family cytokines, which includes interleukin (IL)-2, IL-4, IL-7, IL-9, IL-15 and IL-21 (Liao et al., 2013, Immunity, 38:13-25. IL-2 has been widely studied as an immunotherapeutic agent for cancer. The supplement of IL-2 enhanced the antitumor ability of anti-CD19 CAR-T cells in the clinical trials (Xu et al., 2013, Lymphoma, 54:255-60). However, the administration of IL-2 is limited by side effects and a propensity for expansion of regulatory T cells and the effect of activated induced cell death (AICD) (Malek et al., 2010, Immunity, 33:153-65; and Lenardo et al., 1999, Annu Rev Immunol, 17:221-53). IL-7, IL-15, and IL-21 each can enhance the effectiveness of adoptive immunotherapies and seems to be less toxicity compared with IL-2 (Alves et al., 2007, Immunol Lett, 108:113-20). Despite extensive preclinical and clinical studies on the role of the above cytokines, multi-parameter comparative studies on the roles of various exogenous γ$_c$ cytokines on CAR-T cell adoptive therapy are lacking.

Besides γ-chain cytokines, IL-18 is another immunostimulatory cytokine regulating immune responses, which enhances the production of IFN-γ by T cells and augments the cytolytic activity of CTLs (Srivastava et al., 2010, Curr Med Chem, 17:3353-7). Administration of IL-18 is safe and well tolerated, even when the dose reaching as high as 1000 µg/kg (Robertson et al., 2006, Clin Cancer Res, 12:4265-73). Therefore, IL-18 could be another candidate used to boost the antitumor of CAR-T cells.

In this example, the effect of administration of different exogenous cytokines was examined for expansion, phenotype, in vitro effector functions, and in vivo anti-tumor efficacy of T cells and folate receptor alpha (FRα) CART cells.

The following materials and methods were used in the experiments described in this example.

CAR Construction and Lentivirus Preparation

The pELNS-C4-27z CAR vector was constructed as described previously (manuscript under review), Briefly, the pHEN2 plasmid containing the anti-FRα C4/AFRA4 scFv was used as a template for PCR amplification of C4 fragment using the primers of 5'-ata<u>ggatcc</u>agctggtggagtctgggggaggc-3' (SEQ ID NO: 3) and 5'-ata<u>gctagc</u>acctaggacggtcagcttggtccc-3' (SEQ ID NO: 4) (BamHI and NheI were underlined). The PCR product and the third generation self-inactivating lentiviral expression vectors pELNS were digested with BamHI and NheI. The digested PCR products were then inserted into the pELNS vector containing CD27-CD3z T-cell signaling domain in which transgene expression is driven by the elongation factor-1α (EF-1α) promoter.

High-titer replication-defective lentivirus was generated by transfection of human embryonic kidney cell line 293T (293T) cells with four plasmids (pVSV-G, pRSV.REV, pMDLg/p.RRE and pELNS-C4-27z CAR) by using Express In (Open Biosystems) as described previously. Supernatants were collected at 24 h and 48 h after transfection and concentrated by ultracentrifugation. The virus titers were determined based on the transduction efficiency of lentivirus to SupT1 cells by using limiting dilution method.

T Cells and Cell Lines

Peripheral blood lymphocytes were obtained from healthy donors after informed consent under a protocol approved by University Institutional Review Board at the University of Pennsylvania. The primary T cells were purchased from the Human Immunology Core after purified by negative selection. T cells were cultured in complete media (RPMI 1640 supplemented with 10% FBS, 100 U/mL penicillin, 100 µg/mL streptomycin sulfate) and stimulated with anti-CD3 and anti-CD28 mAbs-coated beads (Invitrogen) at a ratio of 1:1 following the instruction. Twenty-four hours after activation, cells were transduced with lentivirus at MOI of 5. Indicated cytokines were added to the transduced T cells from the next day with a final concentration of 10 ng/mL. The cytokines were replaced every 3 days. The 293T cell used for lentivirus packaging and the SupT1 cell used for lentiviral titration were obtained from ATCC. The established ovarian cancer cell lines SKOV3 (FRα+) and C30 (FRα−) was used as target cell for cytokine-secreting and cytotoxicity assay. For bioluminescence assays, SKOV3 was transduced with lentivirus to express firefly luciferase (fLuc).

Flow Cytometric Analysis and Cell Sorting

Flow cytometry was performed on a BD FACSCanto. Anti-human CD45 (HI30), CD3 (HIT3a), CD8 (HIT8a), CD45RA (HI100), CD62L (DREG-56), CCR7 (G043H7), IL-7Rα (A019D5), CD27 (M-T271), CD28 (CD28.2), CD95 (DX2), TNF-α (MAb11), IFN-γ (4S.B3), IL-2 (MQ1-17H12), perforin (B-D48), granzym-B (GB11) were obtained from Biolegend. Biotin-SP-conjugated rabbit anti-human IgG (H+L) was purchased from Jackson Immunoresearch and APC conjugated streptavidin was purchased from Biolegand. Anti-human Bcl-xl (7B2.5) was purchased from SouhernBiotech. Apoptosis kit and TruCount tubes were obtained from BD Bioscience. For peripheral blood T cell count, blood was obtained via retro-orbital bleeding and stained for the presence of human CD45, CD3, CD4 and CD8 T cells. Human CD45+-gated, CD3+, CD4+ and CD8+ subsets were quantified with the TruCount tubes following the manufacturer's instructions.

In Vivo Study of Adoptive Cell Therapy

Female non-obese diabetic/severe combined immunodeficiency/γ-chain$^{-/-}$ (NSG) mice 8 to 12 weeks of age were obtained from the Stem Cell and Xenograft Core of the Abramson Cancer Center, University of Pennsylvania. The mice were inoculated subcutaneously with $3 \times 10^6$ fLuc$^+$ SKOV3 cells on the flank on day 0. Four or Five mice were randomized per group before treatment. After tumors became palpable, human primary T cells were activated and transduced as described previously. T cells were expanded in the presence of IL-2 (5 ng/mL) for about 2 weeks. When the tumor burden was ~250-300 mm$^3$, the mice were injected with $5 \times 10^6$ CAR-T cells or 100 μl saline intravenously and then received daily intraperitoneal injection of 5 μg of IL-2, IL-7, IL-15, IL-18, IL-21 or phosphate buffer solution (PBS) for 7 days. Tumor dimensions were measured with calipers and tumor volumes were calculated with the following formula: tumor volume=(length×width$^2$)/2. The number and phenotype of transferred T cells in recipient mouse blood was determined by flow cytometry after retro-orbital bleeding. The mice were euthanized when the tumor volumes were more than 2000 mm$^3$ and tumors were resected immediately for further analysis.

Statistical Analysis

Statistical analysis was performed with Prism 5 (GraphPad software) and IBM SPSS Statistics 20.0 software. The data were shown as mean±SEM unless clarified. Paired sample t-tests or nonparametric Wilcoxon rank tests were used for comparison of two groups and repeated measures ANOVA or Friedman test were used to test statistical significance of differences among three or more groups. Findings were considered as statistically significant when P-values were less than 0.05.

Results

1. Construction and Expression of Anti-FRα C4 CAR

Figure 1A:
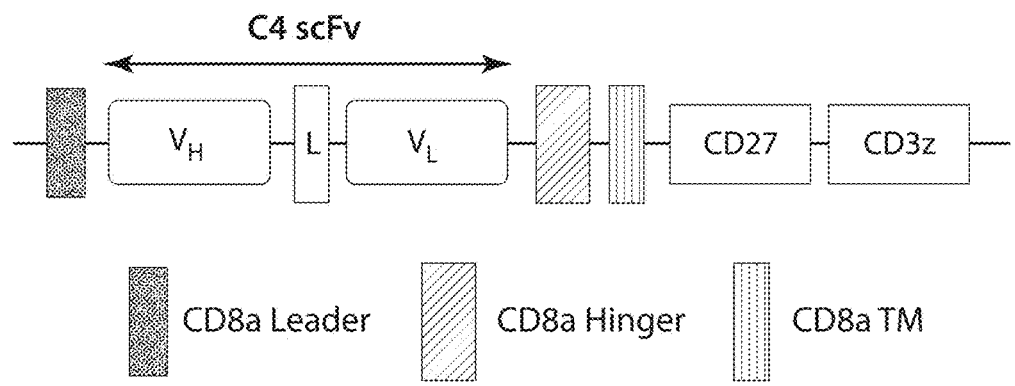
FIGS. 1A-1D show the differential effects of $\gamma_c$ cytokines and IL-18 on CAR-T cell accumulation.

The pELNS-C4-27z CAR comprised of the anti-FRα C4 scFv linked to a CD8a hinge and transmembrane region, followed by a CD3t signaling moiety in tandem with the CD27 intracellular signaling motif (FIG. 1A). Primary human T cells were efficiently transduced with C4 CAR lentiviral vectors with transduction efficiencies of 43%-65% when detected at 48 h after transduction. CAR expression levels were comparable between CD4+ and CD8+ T cells (52.6±10.2% vs. 49.5±17.1%, P=0.713).

2. Influence of Cytokines on Expansion of CAR Transduced T (CAR-T) Cell

Figure 1B:
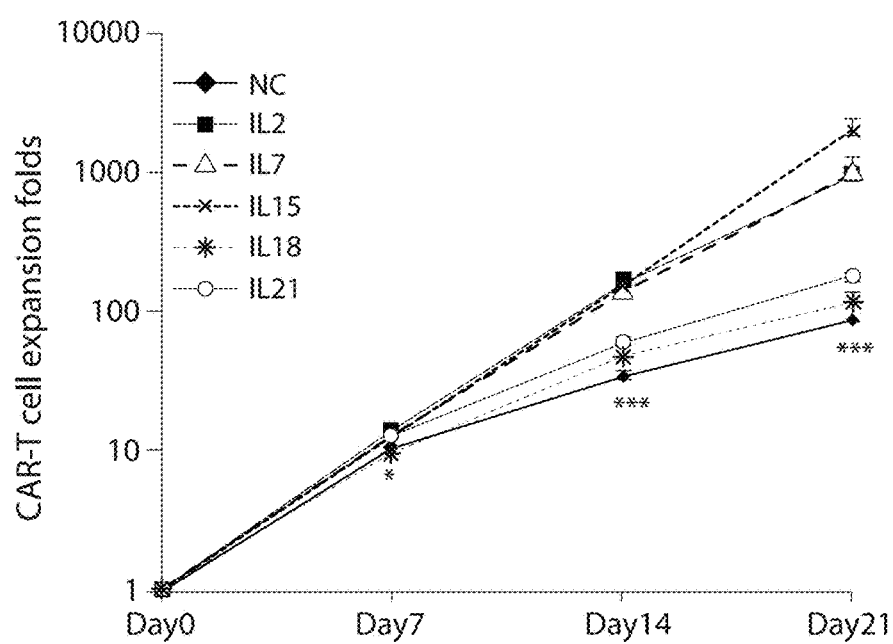

The expansion and accumulation of CAR-T cells in the presence of various γc cytokines and IL-18 was investigated. Three weeks after exposure to the different cytokines in culture, CAR-T cells that had been cultured in the presence of IL2, IL-7 or IL-5 had expanded 1000-2000 fold. CAR-T cells that had been cultured in the presence of IL-18, IL-21 or NC (control, no cytokine) demonstrated a less than 200 fold expansion (FIG. 1B).

Figure 1C:
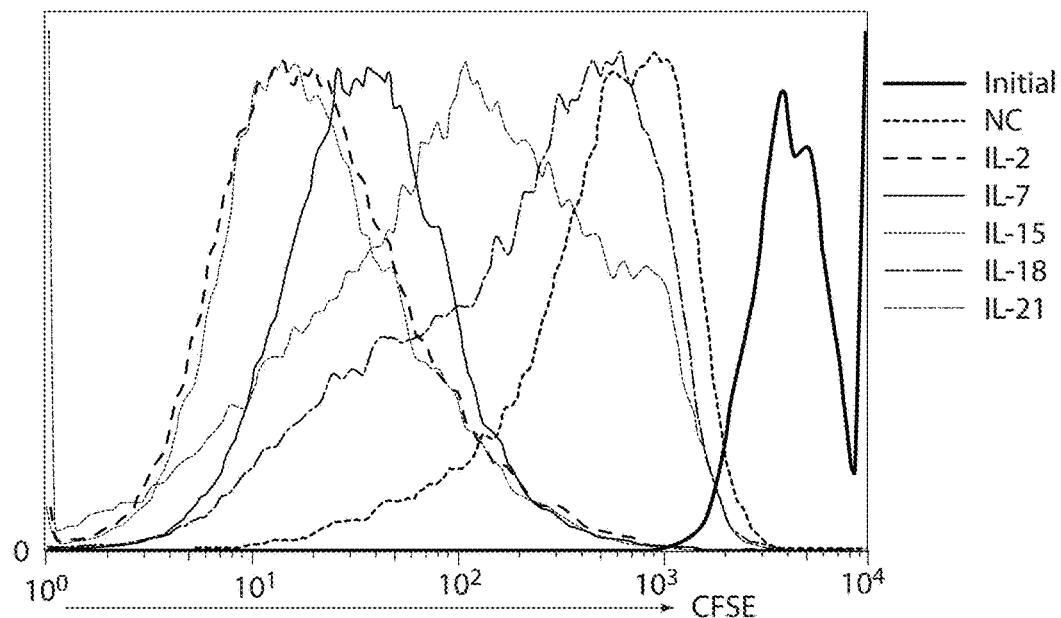
Figure 1D:
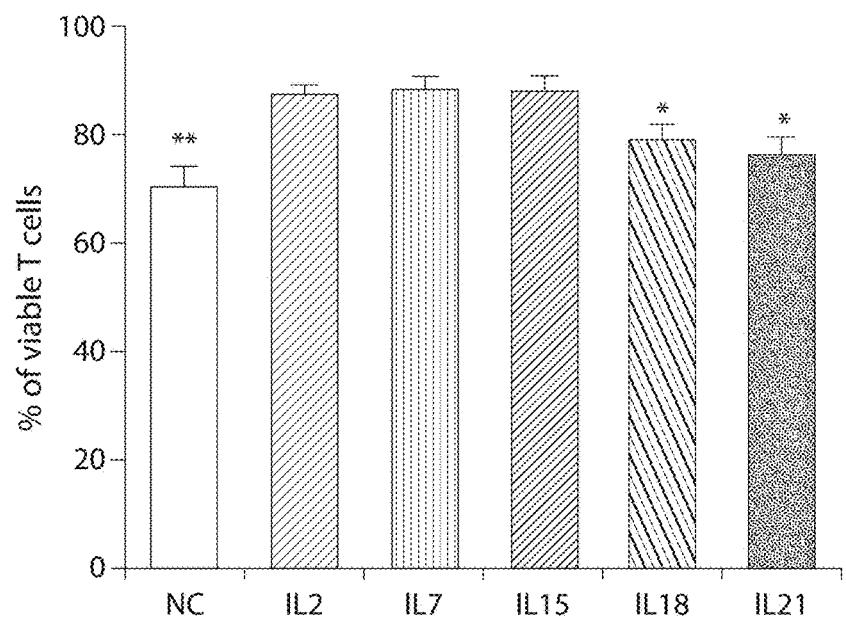

The reasons contributing to the higher accumulation of CAR-T cells were analyzed, specifically, proliferation and apoptosis of the T cells was assessed. The proliferative response was measured by monitoring cell division of CFSE labeled T cells cultured for 7 days. As shown in FIG. 1C, T cells cultured with IL-2 and IL-15 showed the highest proliferative ability, followed by IL-7; while IL-21 and IL-18 were less potent mitogenic stimulants. Apoptosis of the T cells cultured in the different cytokines was tested using Annexin-V staining. The results indicated that T cells cultured in IL-2, IL-7 and IL-15 underwent less apoptosis when compared with NC, IL-18 and IL-21 groups (FIG. 1D). These results indicate that increased accumulation of T cells expanded in the presence of cytokines, e.g., IL-2, IL-7, or IL-15, may be caused by both an increase in proliferation and a decrease in apoptosis, e.g., by activation of the Bcl-xl anti-apoptotic pathway.

3. Influence of Cytokines on the Phenotypes of CAR-T Cells

Figure 2A:
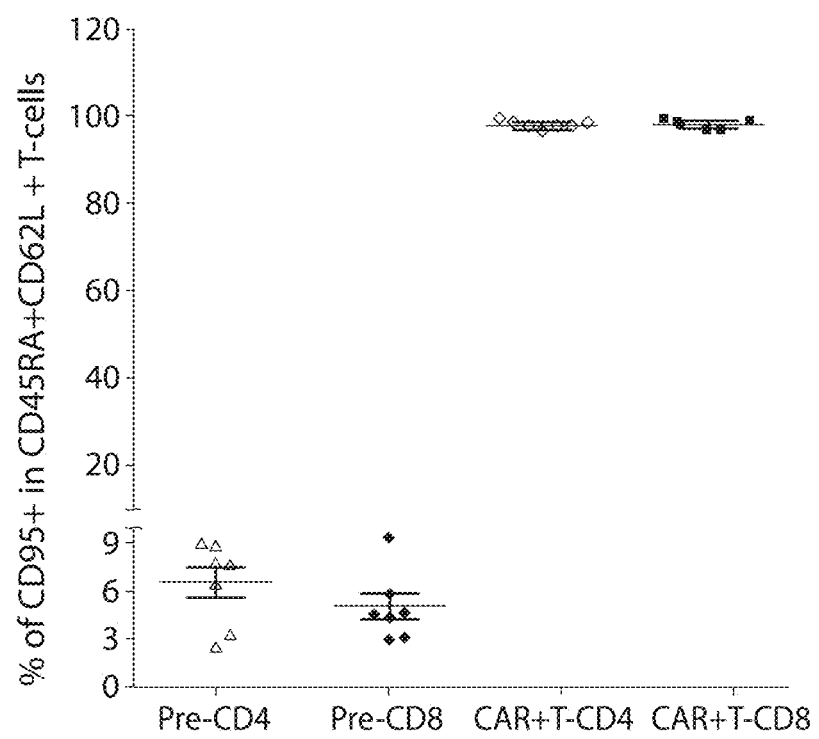
FIGS. 2A-2F shows the memory T cell subsets of CAR-T cells.
Figure 2B:
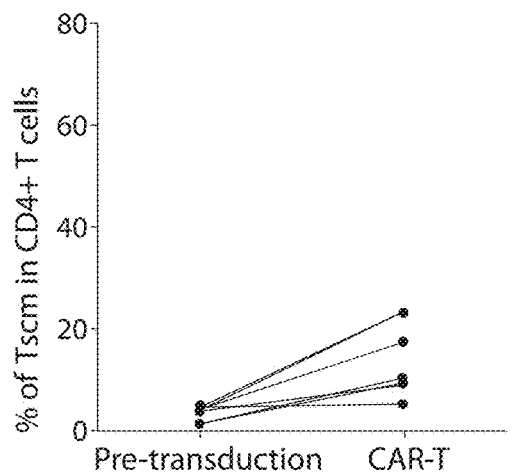
Figure 2C:
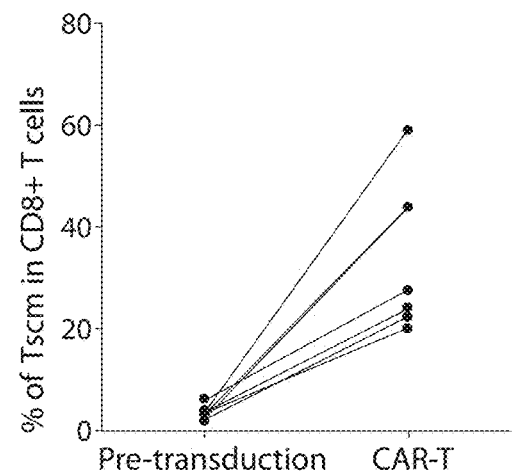
Figure 2D:
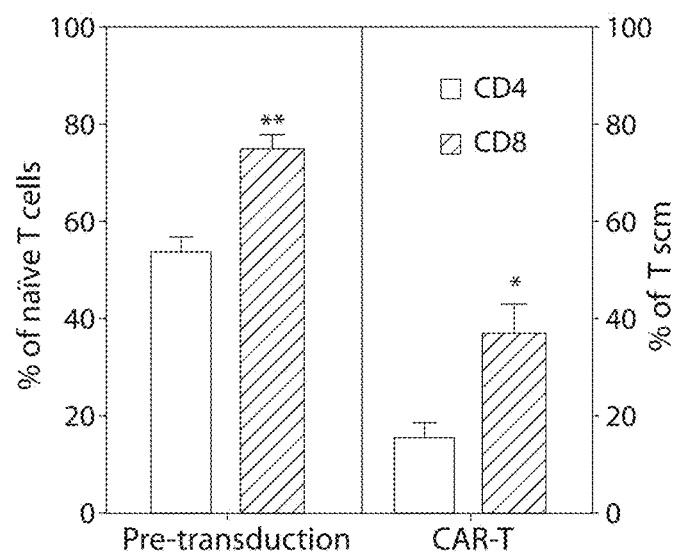

Next, the phenotype of the CAR-T cells expanded in the presence of exogenous cytokines was examined. The fresh T cells from healthy donors were generally divided into four subsets based on CD45RA and CD62L expression: 1) naïve T cell (CD45RA+CD62L+, referred to as Tn), 2) central memory T cell (CD45RA−CD62L+, referred to as Tcm), 3) effector memory T cell (CD45RA−CD62L−, referred to as Tem) and 4) CD45RA positive effector T cell (CD45RA+CD62L−, referred to as Temra). Then the expression of CCR7, CD27, CD28, and CD95 are further evaluated for each subset. The CD95 expression was significantly upregulated upon lentiviral transduction. The latter three T cell subsets were positive for CD95 while only small part of Tn expressed CD95 (3.6±1.4% in CD4+ and 3.7±1.3% in CD8+ T cells). This small population also co-expressed CD27, CD28 and CCR7, and was considered as memory stem T cells (Tscm). However, after stimulation with anti-CD3/CD28 beads before and after lentiviral transduction with CAR, CD95 was greatly up-regulated to nearly 100% in this population (FIG. 2A). The percentages of CD45RA+CD62L+CD95+ T cells were greatly expanded after anti-CD3/CD28 bead stimulation in both CD4+ and CD8+ T and CAR-T cells when compared with the fresh T cells (FIGS. 2B and 2C). This population highly expressed CD27, CD28 and CCR7 simultaneously, indicating it could be defined as Tscm. Furthermore, CD8+ CAR-T cells had a higher percentage of Tscm cells, which may be related to the higher proportion of Tn in initial CD8+ T cells (FIG. 2D).

Fourteen days after co-culture with various cytokines, the proportion of T cell subsets of CAR-T cells were investigated by measuring the expression of CD45RA, CD62L and CD95. Of the CD4+ CAR-T cells, a significantly higher percentage of Tscm cells existed in the IL-7 group compared with the IL-2 group, while the no cytokine (NC) and IL-18 groups presented lower percentages of Tscm but higher percentages of Tcm. The distribution of T cell subsets in the IL-15 group was similar with the IL-2 group, while the IL-21 group presented a higher percentage of Tcm, while percentage of Tscm was comparable with the IL-2 group. The CD8+ CAR-T cells demonstrated a similar trend as that of the CD4+ CAR-T cells on the differentiation and distribution of the four T cell subsets for each cytokine-administered group, with higher proportions of Tscm compared with CD4+ CAR-T cells in the corresponding group of CD8+ CAR-T cells.

Figure 2E:
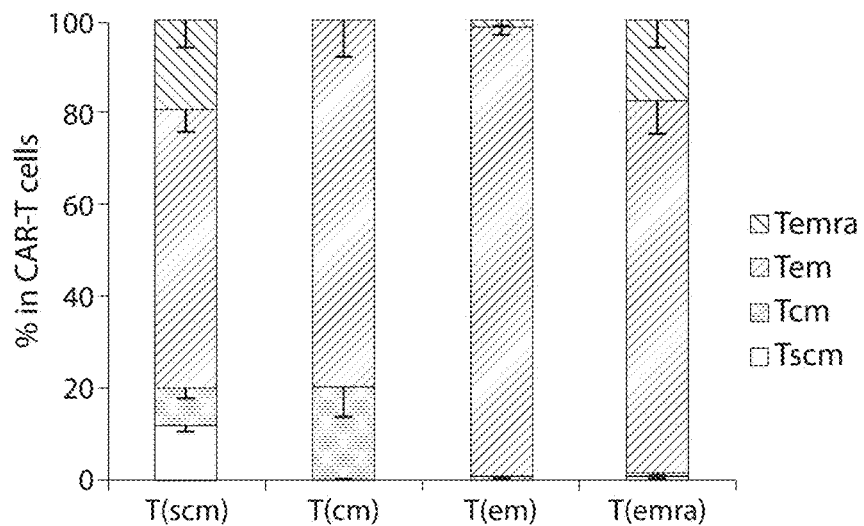
Figure 2F:
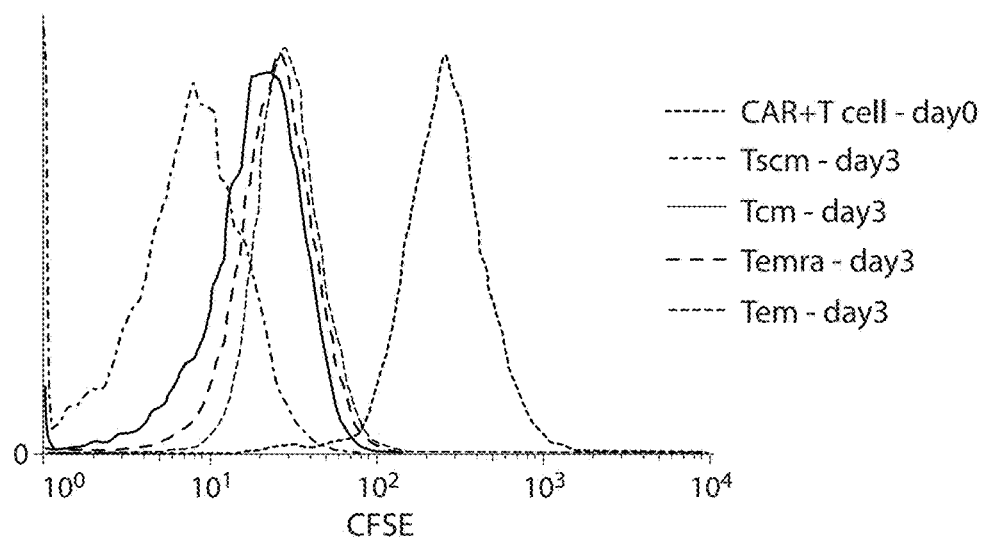
Figure 3A:
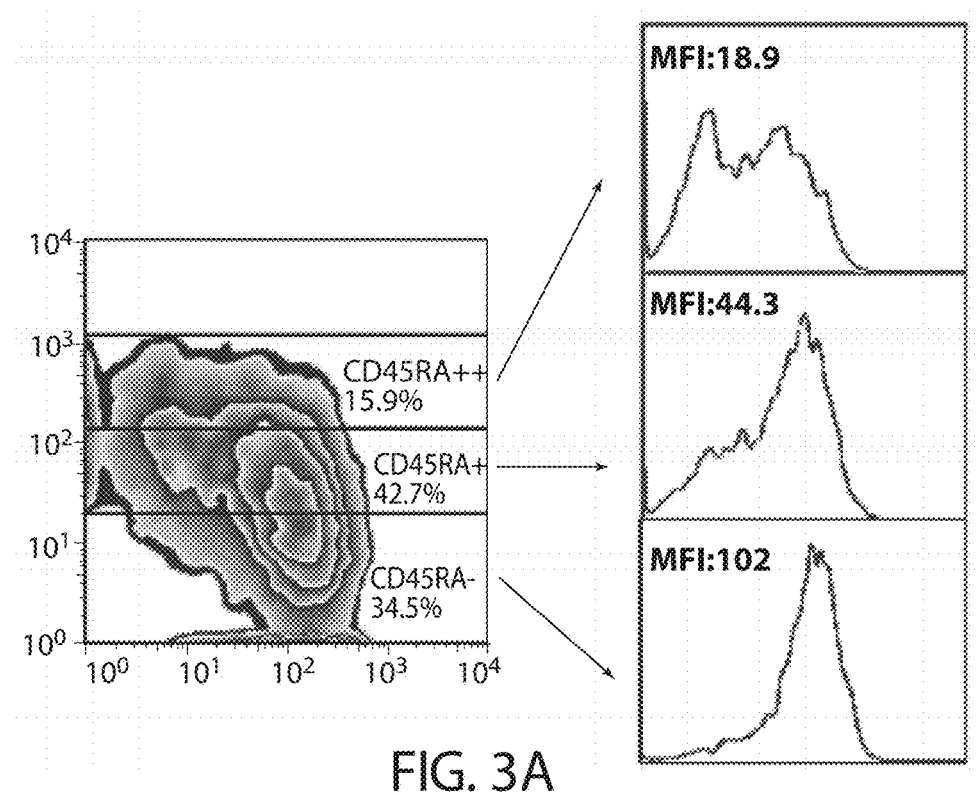
FIG. 3A-3B show the correlation between CD45 RA expression and CFSE intensity.
Figure 3B:
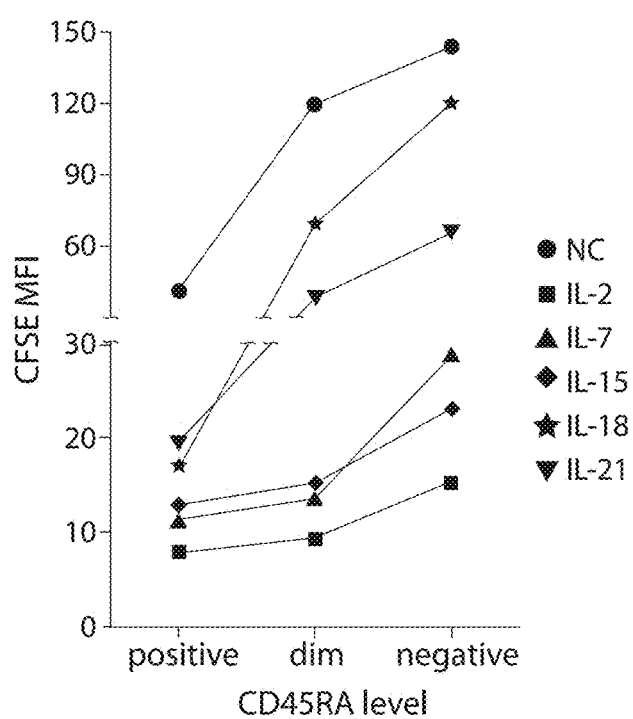
Figure 4:
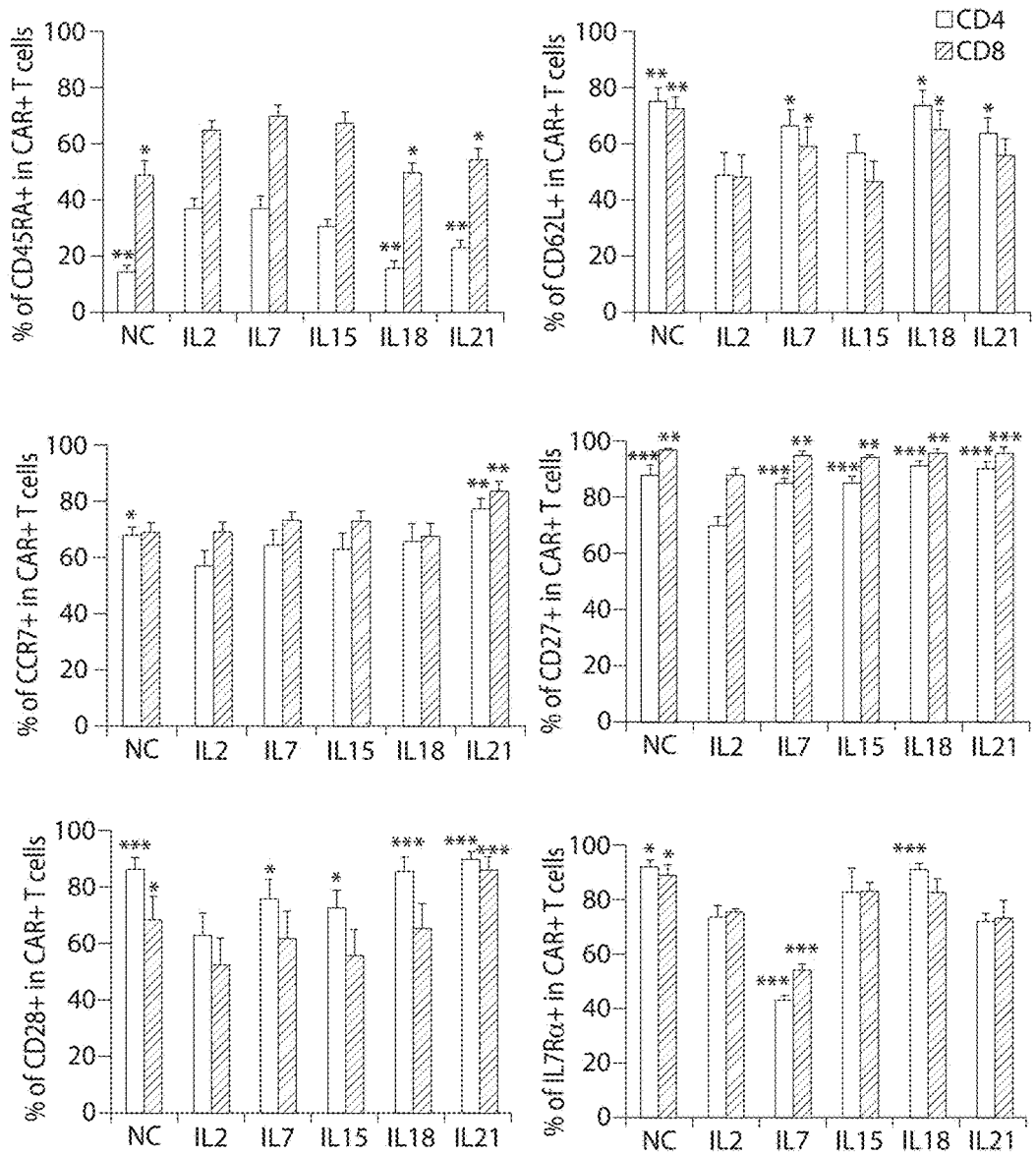
FIG. 4 shows the phenotypes of CAR-T cells resulting from exposure to different cytokines.

The abilities of various CAR-T cell subpopulations to self-renew and to differentiate into other cell types were further studied. The four subsets of CAR-T cells were sorted based on CAR, CD45RA and CD62L expression and cultured separately in medium containing IL-2 for 3 days. As shown in FIG. 2E, the Tscm subset was able to differentiate into all the other three subsets, and Tcm and Temra subsets were able to differentiate into Tem. These results indicate that CD62L+ and CD45RA+ T cells were able to differentiate into CD62L- and CD45RA- T cells, respectively. The proliferation capacity of the four subsets was assessed by CFSE dilution and then compared. The results showed the Tscm presented stronger proliferation ability than other subsets (FIG. 2F). Furthermore, CD45RA expression inversely correlated with CFSE intensity while CD62L and CCR7 expression directly correlated with proliferation. In all cytokine groups, CD45RA+ T cells exhibited much lower CFSE levels than CD45RA dim and negative T cells (FIG. 3A-3B), indicating that CD45RA+ T cells had stronger proliferation activity than CD45RA- T cells. Thus, the increased accumulation of T cells grown in the presence of IL-2, IL-7 and IL-15 may be related to the increased proportion of CD45RA+ T cells (which have increased proliferation capacity) (FIG. 4).

With regard to the phenotype of the CAR-T cells, CAR-T cells presented lower expression of CD45RA, CD62L, CD27 and CD28, but higher expression of CCR7 on the surface of T cells. The influence of cytokines on the phenotype of CAR-T cells were further assessed based on the expression of the following surface markers: CD27, CD28, CD62L, CCR7 and IL7Ra. CAR-T cells grow in the presence of IL-18 showed quite similar expression pattern with those grown without cytokine supplement. IL-2 dramatically down-regulated the expressions of CD27, CD28 CD62L, CCR7 and ILR7a when compared with NC control. Of the other γc cytokines, compared with IL-2 exposed CAR-T cells, IL-7 exposed CAR-T cells presented higher CD62L, CD27 and CD28 expression but significantly decreased CCR7 expression; IL-15 group CAR-T cells presented higher CD27 and CD28 expression; and IL-21 exposed CAR-T cells presented higher CD62L, CCR7, CD27 and CD28 expression, indicating that IL-2 exposure induced the expansion of a subset of T cells with a much more mature T cell phenotype than all other groups (FIG. 4).

4. Influence of Cytokines on the Effector Function of CAR-T Cells

Figure 5A:
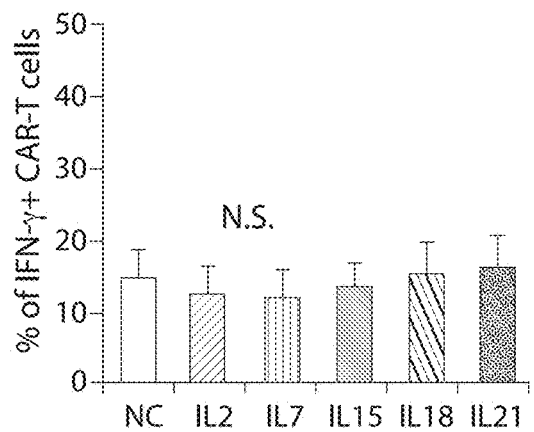
FIGS. 5A-5D show the Functional analysis of CAR-T cells exposed to different cytokines.
Figure 5B:
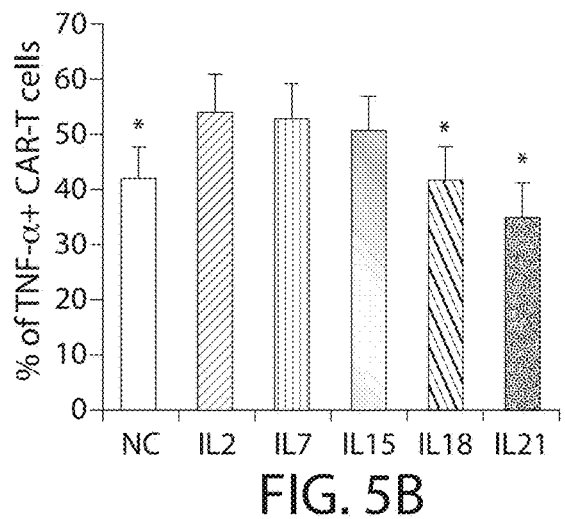
Figure 5C:
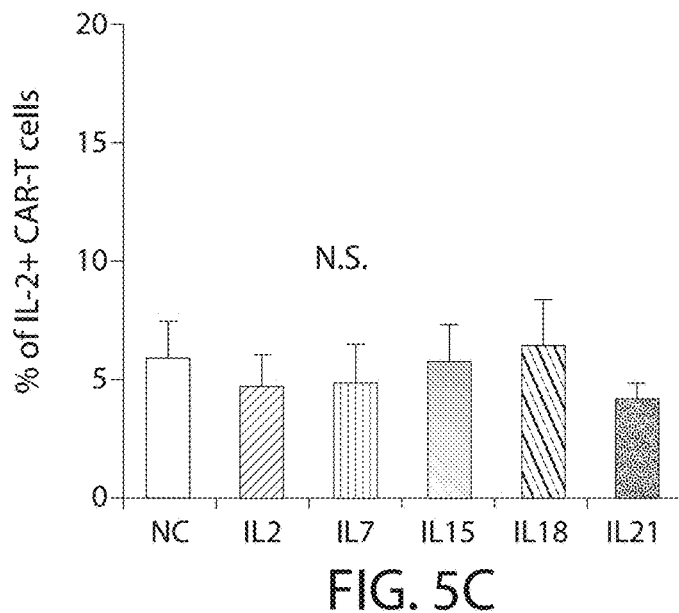

To investigate the influence of cytokines on CAR-T cell effector function, the cytokine production capability of CAR-T cells after stimulation with FRα-expressing SKOV3 cells was assessed. Following 5 hours stimulation, TNF-α, IFN-γ and IL-2 were detectable in the cytoplasm of CAR-T cells, with 41.5-54.0% of the CAR-T cells produced TNF-α, 12.4-15.3% of the CAR-T cells produced IFNγ, and 4.3-6.5% of CAR-T cells produced and IL-2 (FIGS. 5A-5C). IL-2, IL-7 and IL-15 exposure during expansion promoted CAR-T cells to produce TNF-α, while the numbers of IFN-γ and IL-2 producing CAR-T cells were comparable among all the cytokine groups (FIGS. 5A, 5B, and 5C). Next, the fractions of responding CAR-T cells and their polyfunctionality were compared. In comparison to exposure to IL-2 during expansion, exposure to IL-18, IL-21 or no cytokine exposure during expansion induced less cytokine-producing CAR-T cells, and less CAR-T cells possessed the ability to produce multiple cytokines when stimulated by target cells. These results are consistent with the phenotype that the CAR-T cells in IL-18, IL-21 and NC groups were less differentiated than those in the IL-2 exposed group.

Then, the effect of cytokine exposure during expansion on the expression of the cytolytic molecules perforin and granzyme-B after antigen stimulation was determined. Similar with TNF-α production, the CAR-T cells exposed to IL-2, IL-7, and IL-15 demonstrated increased perforin expression compared with CAR-T cells exposed to NC, IL-18 and IL-21. However, although CAR-T cells exposed to IL-21 produce less TNF-α and perforin, they produced the highest level of granzyme-B. The next highest levels of granzyme-B production were observed in CAR-T cells exposed to IL-2 and IL-15 during expansion. CAR-T cells in IL-18 group presented the least amount of both perforin and granzyme-B expression after antigen stimulation.

Figure 5D:
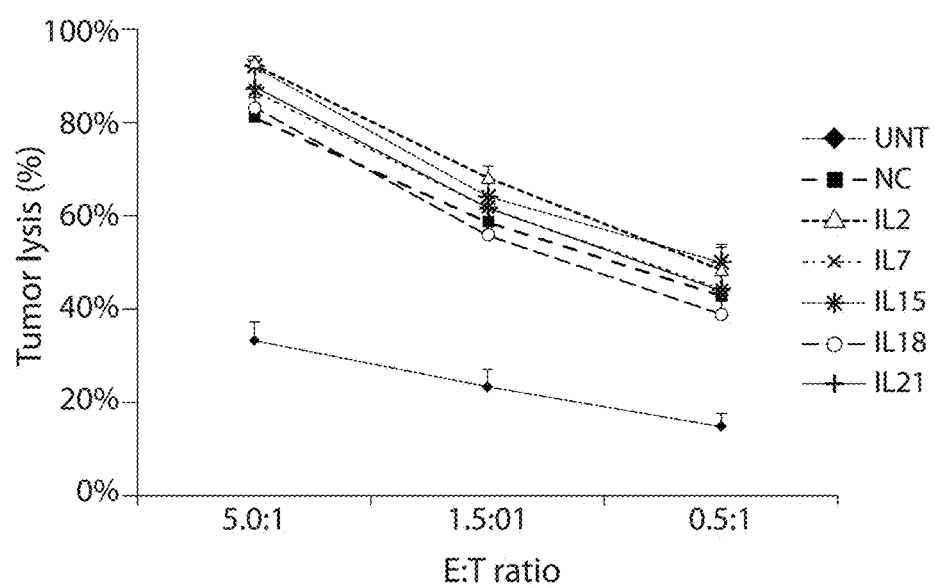

Finally, the tumor lysis activity by CAR-T cells exposed to various cytokines during exposure was quantified by luciferase assay. As shown in FIG. 5D, CAR-T cells co-cultured with IL-2 and IL-15 lysed the SKOV3 more efficiently than those with NC and IL-18 (both $P<0.05$).

The association between phenotype of the CAR-T cells and their function was further confirmed. The T cells 14 days were sorted after lentiviral transduction based on CAR and CD62L expression. The CD62L+ CAR-T cells (Tscm and Tcm) exhibited less cytokine production activity and weaker cytolytic capacity when compared with CD62L-CAR-T cells (Tem and Temra) (FIGS. 6A-6C). In this perspective, CAR-T cells exposed to IL-2 and IL-15 produced more cytokines and presented stronger tumor lysis activity, which might be partially attributed to the higher proportions of Tem and Temra in these groups.

5. Expansion and Phenotype of CAR-T Cells after Antigen Challenge

Figure 7A:
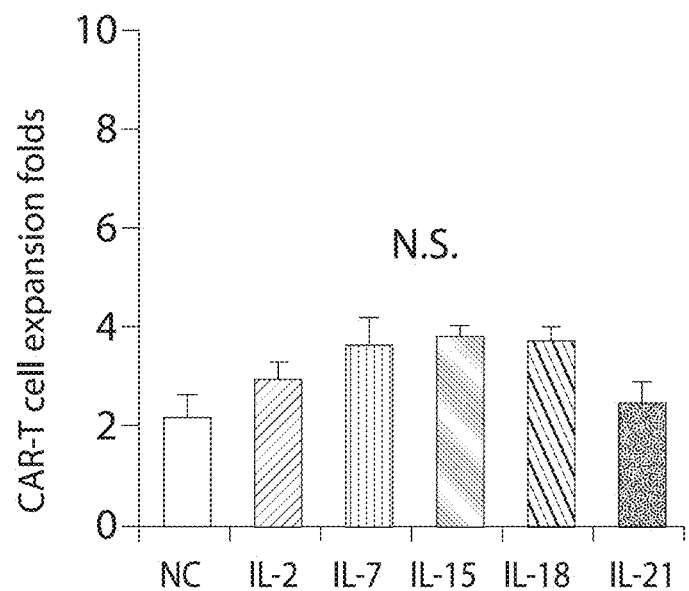
FIGS. 7A-7B show the expansion and phenotype of CAR-T cells exposed to antigen challenge.
Figure 7A:
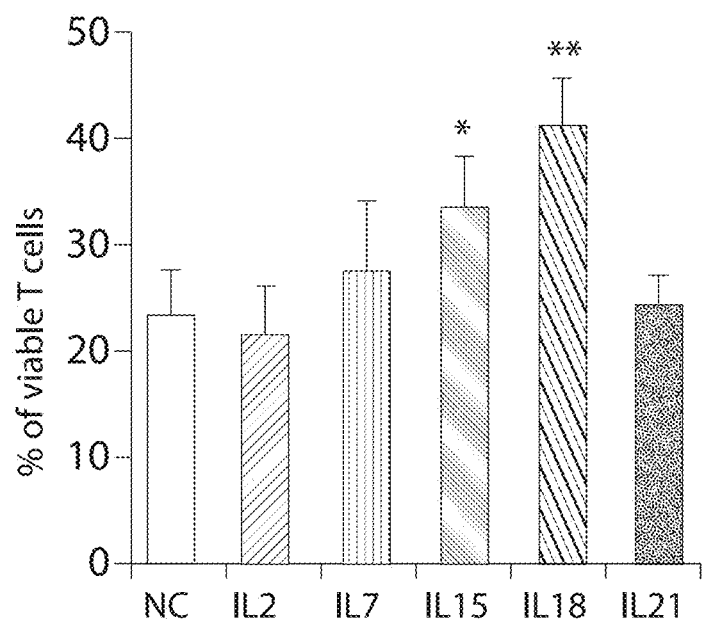
Figure 7B:
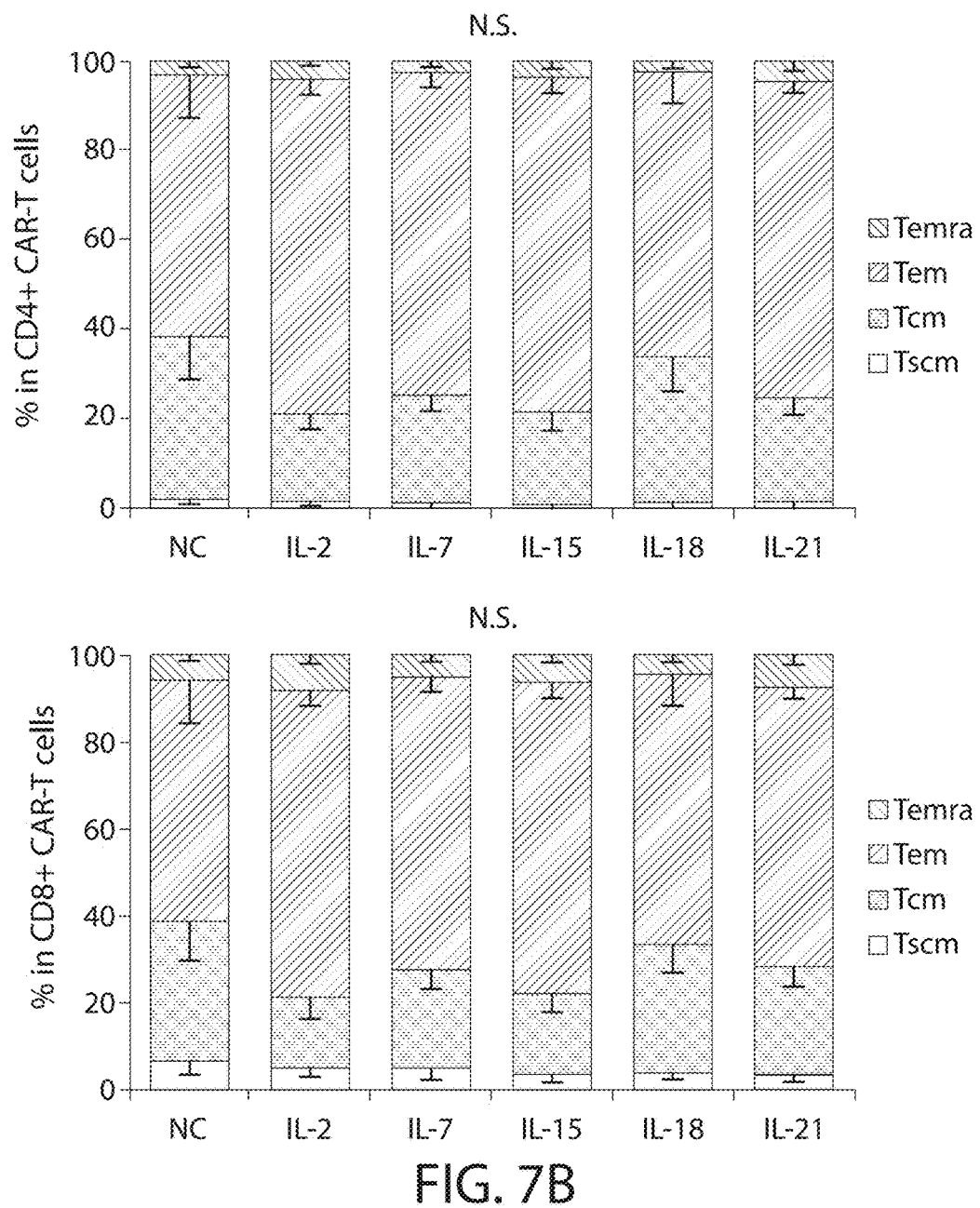

To investigate the influence of cytokines on CAR-T cell expansion under the challenge of specific antigen, the CAR-T cells exposed to IL-2 for two weeks were co-cultured with SKOV3 (FRα+) or C30 (FRα−) cells in the presence of indicated cytokines for 7 days. Similar to the antigen-free circumstance, CAR-T cells exposed to IL-2, IL-7 and IL-15 presented higher fold expansion than CAR-T cells exposed to other cytokines. The CAR-T cells exposed to IL-21 during expansion were more likely to undergo apoptosis. However, when the CAR-T cells exposed to the indicated cytokines for two weeks were co-cultured with SKOV3 or C30 cells without further cytokine supplement for 7 days, the accumulation of CAR-T cells were comparable among all groups, with those having been exposed to IL-15 and IL-18 undergoing the least amount of apoptosis (FIG. 7A). The phenotypes of CAR-T cells were also analyzed. As to the four subsets of memory T cells, the results were different from antigen-free study: Tscm was rare and Tem accounted for more than 50% in no cytokine, IL-18 and IL-21 all groups. Cytokines had no significant impact on the composition of memory T subsets and IL-7 exposure did not favor the increase of Tscm (FIG. 7B).

6. Anti-Tumor Efficacy of Various Cytokines in Animal Models

Figure 8A:
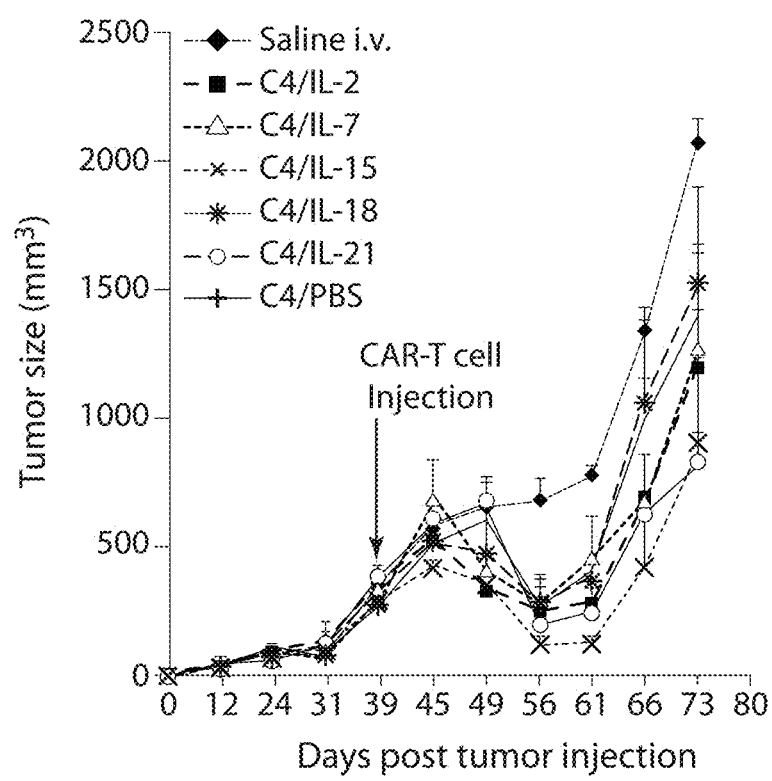
FIGS. 8A-8C show the antitumor activity of various CAR-T cells with previous cytokine exposure.
Figure 8B:
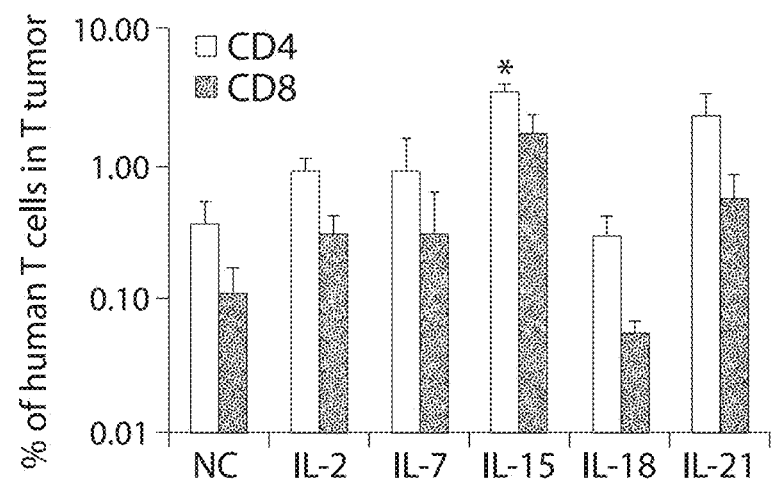
Figure 8C:
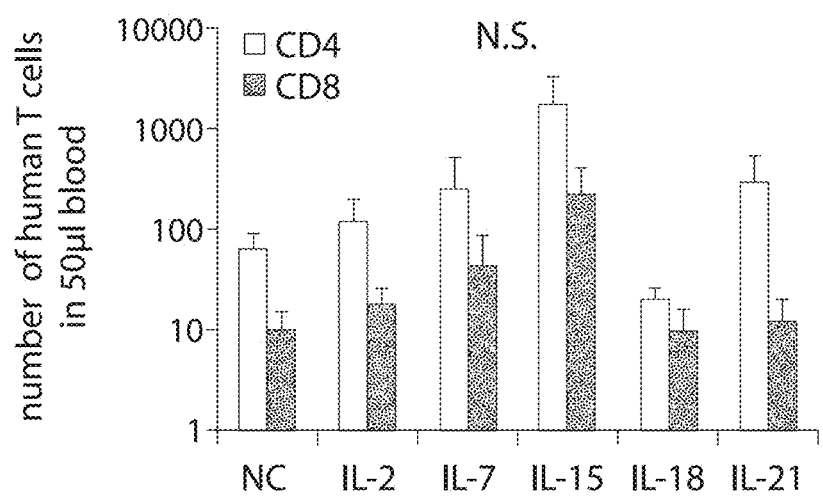

To evaluate the effects of various cytokines during ex vivo expansion of CAR-T cells on the efficacy of CAR-T cells in vivo, the persistence of CAR-T cells and outcome was investigated by using a NSG mouse xenograft model of ovarian cancer. Mice bearing subcutaneous SKOV3 tumors were intravenously injected with two doses of 5×106 C4-27z CAR-T cells which had been exposed to the indicated cytokines ex vivo for 2 weeks previously. All mice receiving C4-27z CAR-T cell infusion presented less tumor burden when compared with those injected with untransduced T cells and anti-CD19 CAR-T cells (FIG. 8A). Of the various cytokine groups, mice receiving CAR-T cells with previous IL-2 exposure showed the highest tumor burden, consistent with the least amount of circulating human T cell in these mice. The tumors in NC, IL-7, IL-15, IL-18 and IL-21 groups were all significantly suppressed or even disappeared, without any statistical difference on tumor size. The persistence of transferred T cells in the peripheral blood was determined 15 and 32 days after adoptive transfer. Mice receiving IL-7 and IL-21 treated CAR-T cells seemed to have higher amount of human T cells than other groups in the peripheral blood on day +15, while mice receiving IL-2 treated CAR-T cells had the lowest number of human T cells (FIGS. 8B-8C). As to the percentages of different CAR-T cell populations, NC, IL-15, IL-18 and IL-21 exposed groups all presented higher CD4+ CAR-T cells when compared with IL-2 group, while the percentages of CD8+ CAR-T cells were comparable among all the groups. Of the T cell phenotypes, CD62L, CD27 and CD28 were expressed only on about 5-10% of T cells and were comparable among all groups, except that CD8+ T cells in IL-21 group expressed higher CD28 than those in IL-2 and NC group (both P<0.05). On day +32, the circulating human T cells in all CAR-T cell groups expanded significantly except the IL-2 group, with an average T cell account of 14907/µl to 19651/µl (and only 242/µl in the IL-2 group). Two mice died although the tumors were regressed.

Discussion

IL-2 is the most frequently used cytokine for generating lymphocytes for adoptive immunotherapy. It promotes T cell survival and expansion, enhances tumor-killing ability of T cells. However, the action of IL-2 is limited as it results in activation induced cell death (AICD) of T-cell and the development of regulatory T-cell (Malek et al., *Immunity*, 2010, 33:153-65; and Lenardo et al., *Annu Rev Immunol*, 1999, 17:221-53). In this example, IL-2 significantly increased the accumulation of CAR-T cells and their cytotoxicity ability, but IL-2 exposed CAR-T cells presented inferior antitumor immunity in vivo following adoptive transfer. This finding demonstrates an inverse relationship between in vitro tumor-lysis and in vivo tumor eradication. IL-2 exposed CAR-T cells displayed a relative mature phenotype with low expression of CD62L, CCR7, CD27 and CD28, which are less persistent in vivo (Yang et al., *Cancer Immunol Immunother*, 2013, 62:727-36). Recent studies have indicated that adoptive transfer of less differentiated T cells correlates with superior tumor regression, which supports the finding that IL-2 exposed CAR-T cells are less effective than other group (Gattinoni et al., *Nat Med*, 2011, 17:1290-7; and Markley et al., *Blood*, 2010, 115:3508-19).

IL-15 presented similar performance of stimulating CAR-T cell expansion and tumor-lysis function as IL-2, but induced a less differentiated phenotype (higher expression of CD27 and CD28). Therefore, IL-15 supports the persistence of CAR-T cells in vivo and shows better antitumor immunity in animal models.

Compared with IL-2 and IL-15, IL-7 showed similar capability to promote CAR-T cell expansion, but induced higher level of CD62L expression and exhibited the highest proportion of CAR-Tscm cells in an antigen-free circumstance. Therefore, compared to CAR-T cells exposed to IL-2, ex vivo exposure of IL-7 without antigen challenge enhanced the antitumor efficacy of the CAR-T cells. IL-7 exposed CAR-T cells did not result in better in vivo antitumor efficacy than IL-2, and efficacy was inferior to IL-15 due to the less expansion of CAR-T cells under antigen challenge.

IL-21 exerted few effects on CAR-T cell accumulation as it could not enhance anti-apoptosis ability, e.g., by promoting Bcl-xL expression. However, IL-21 induced the expansion of less differentiated CAR-T cells, with a phenotype of high expression of CD62L, CCR7, CD27 and CD28, even under the circumstance of antigen challenge. Therefore, IL-21 exposed CAR-T cells showed best persistence in animal models and IL-21 injection in vivo, and also presented a better efficacy in promoting tumor eradication than other cytokine groups except IL-15. These results are consistent with previous finding that less differentiated CAR-T cells correlates with superior tumor regression.

IL-18 is proinflammatory cytokine belonging to the IL-1 family, which regulates both innate and adaptive immune responses by activating monocytes, NK cells, and T cells and production of IFN-γ as well as other cytokines in vivo (Srivastava et al., *Curr Med Chem*, 2010, 17:3353-7). The results presented herein indicates that IL-18 has little impact on CAR-T cell's expansion, phenotype and function in ex vivo experiments, as most of the results in IL-18 groups are similar and comparable with NC group. IL-18 promoted little proliferation of T cells and maintained more T cell survival under antigen challenge compared to the control (NC) group. In vivo studies show that IL-18 has no significant impact on CAR-T cell efficacy when compared with mice without cytokine supplement.

In summary, the findings of these experiments indicate that IL-2 supplement ex vivo for CAR-T cell expansion is not an optimal strategy although it is widely used. As to IL-18, IL-21 or no cytokine supplement, although they may induced relative effective CAR-T cells, they do not promote CAR-T cell expansion effectively enough, such that enough CAR-T cells could be prepared for clinical use in a limited expansion time. Therefore, IL-15 and IL-7 may be better agents for CAR-T cell expansion. Furthermore, the combination of IL-7 and IL-15 supplement instructs the generation of Tscm, which is beneficial to produce more "young" CAR-T cells. As to in vivo cytokine injection, all γc cytokines supplement enhance antitumor efficacy, as many of them favor the expansion of CAR-T cells, with IL-15 presenting best effect. Mice receiving IL-15 exposed CAR-T cells by injection had increased efficacy, due in part to the increased expansion ability and increased persistence of the CAR-T cells during tumor treatment. Thus, the results of these experiments indicate that IL-7 and IL-15 show promise to promote CAR-T cell expansion and induce T cell phenotypes that are most efficacious for therapeutic treatment.

Example 2: Effect of CD25 Depletion on Cell Growth and Transduction Efficiency

The interleukin-2 a-chain, also known as CD25, is expressed by regulatory T cells (Tregs) but has also been observed on chronic B cell leukemia (CLL) cells (in greater than 85% of CLL patients). Tregs have immune suppressing functions and can impede the efficacy of immunotherapy, e.g., by inhibiting T cell proliferation. Current isolation or enrichment of T cells from CLL patients by apheresis usually contains a significantly increased proportion of Tregs as well as CLL cells. The depletion of Tregs and CLL cells in the starting material by CD25 depletion methods may significantly improve the purity of effector T cells, and thereby increase the potency of CAR19 expressing T cells, e.g., CART19 cells.

Optimizing CD25 Depletion

A validation experiment was performed to identify the optimal conditions for CD25 depletion from the aphereses from two patients using CD25 Reagent from Miltenyi in a CliniMACS System. CD25 depletion reagent was used at 100%, 70%, and 30% of the manufacturer's recommended amount to identify whether the same depletion efficiency could be obtained by using less reagent. Two different tubing sets from Miltenyi were also tested. The depletion was performed in accordance with the manufacturer's directions. The results from the experiments are shown in the table below. For control, selection using anti-CD3/CD28 immunomagnetic beads was performed.

Effect of CD25 Depletion on T Cell Population and Proliferation

Next, the quality of the T cell product after CD25 depletion was assessed by determining the proportion of CD4+ and CD8+ T cells and proliferation capacity.

To determine the proportion of specific T cells populations, cells were analyzed by flow cytometry nine days after selection by anti-CD3/CD28 or CD25 depletion as described above. The results show that CD3/CD28– selected T cells had a greater proportion of CD4+ T cells compared to CD25 depleted cells (84.6% compared to 46.8% CD4+ T cells). Conversely, CD25 depleted cells had a greater proportion of CD8+ T cells compared to the CD3/CD28– selected cells (47.2% compared to 11.5% CD8+ T cells). Therefore, CD25 depletion results in T cells with a greater proportion of CD8+ T effector cells.

Figure 10A:
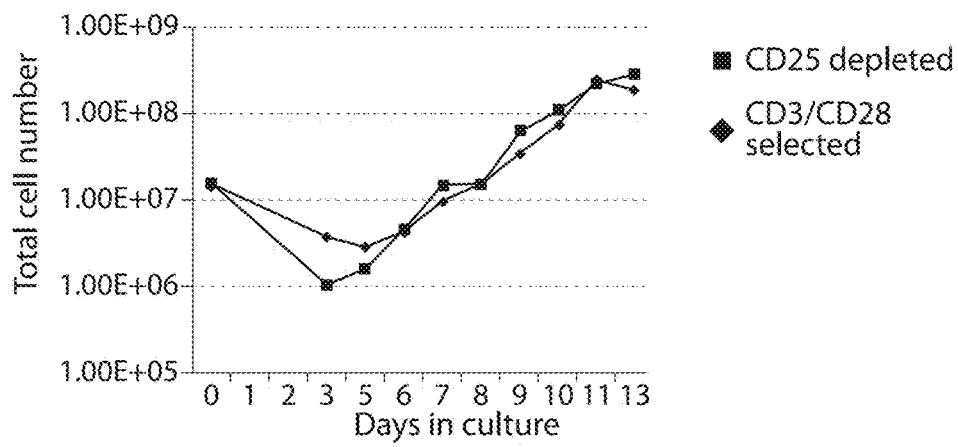
FIGS. 10A, 10B, and 10C show the comparison of proliferation capacity between CD3/CD28 selected cells and CD25 depleted cells.
Figure 10B:
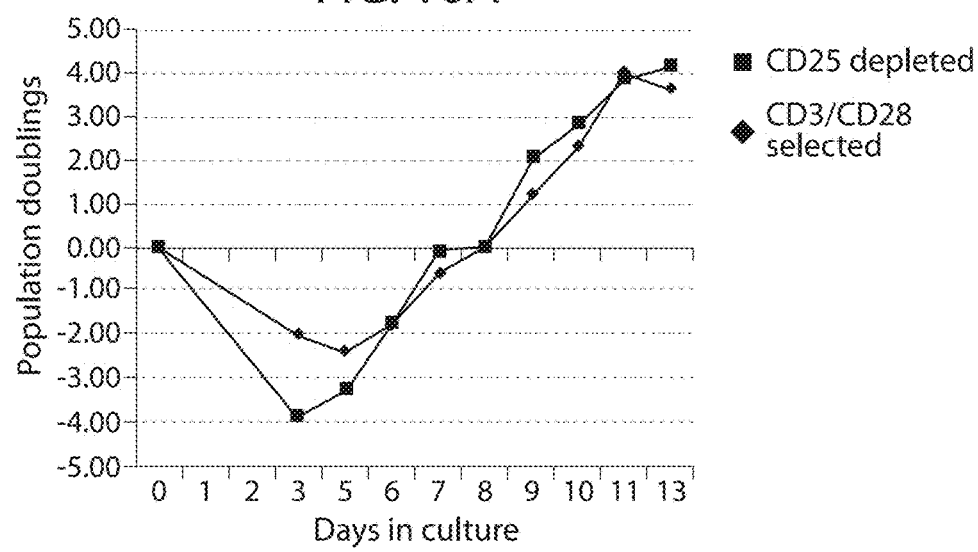

Proliferation capacity and cell viability was also assessed in control (CD3/CD28 selected cells) and CD25 depleted cells. $1.6 \times 10^7$ cells from control and CD25 depleted cells were plated and the cell number and viability was determined over 10-13 days. FIG. 10A shows the total cell number over time and FIG. 10B shows the calculated population doublings (calculated from the total number of cells). The results indicate that the CD25 depleted cells demonstrated similar growth characteristics to the control

TABLE 6

Experimental results from CD25 depletion.

| CD25 depletion arms | | 100% | 70% | 30% |
|---|---|---|---|---|
| Miltenyi tubing set | 161-01 | | | |
| CliniMACS program | ENRICHMENT1.1 | | | |
| Patient cells | UPCC04409-15 | | | |
| % CD45+CD25+ cells | 83.56% | | | |
| % CD45+CD3+ cells | 8.66% | | | |
| % CD45+CD3+CD25– cells | 5.70% | | | |
| #CD25+ cells to target | | 2.E+09 | 2.E+09 | 2.E+09 |
| #apheresed cells for CD25 depletion | | 2.39E+09 | 3.41E+09 | 7.97.E+09 |
| CD25 bead volume used (mL) | | 2.5 | 2.5 | 2.5 |
| Cell# in CD25–depleted fraction | | 1.05E+09 | 1.86E+09 | 3.36E+09 |
| Cell# in CD25–enriched fraction | | 2.05E+08 | 2.58E+08 | 5.19E+08 |
| Expected CD25– T-cell yield | | 1.36E+08 | 1.95E+08 | 4.54E+08 |
| % T cells in depleted fraction | | 6.26% | 4.06% | 2.50% |
| Observed yield CD25– T cells | | 6.57E+07 | 7.55E+07 | 8.40E+07 |
| Yield of CD3+CD25– as % of expected | | 48% | 39% | 18% |
| % B cells in depleted fraction | | 90.50% | 91.6% | 95.30% |
| Viability CD25+ fraction | | 94.4% | 96.2% | 91.1% |
| Viability CD25– fraction | | 95.8% | 95.0% | 99.0% |

The expected CD25– (CD25-negative) T cell yield represents the calculated CD25– T cell yield calculated by assuming 100% efficiency in the respective manipulations. The observed yield of CD25– T cells represents the number of CD25– T cells after the respective manipulations. As shown in Table 6, using less reagent than recommended by the manufacturer did not result in the same efficiency in CD25 depletion. Using different tubing resulted in an increase in T cell enrichment by one log.

Figure 9:
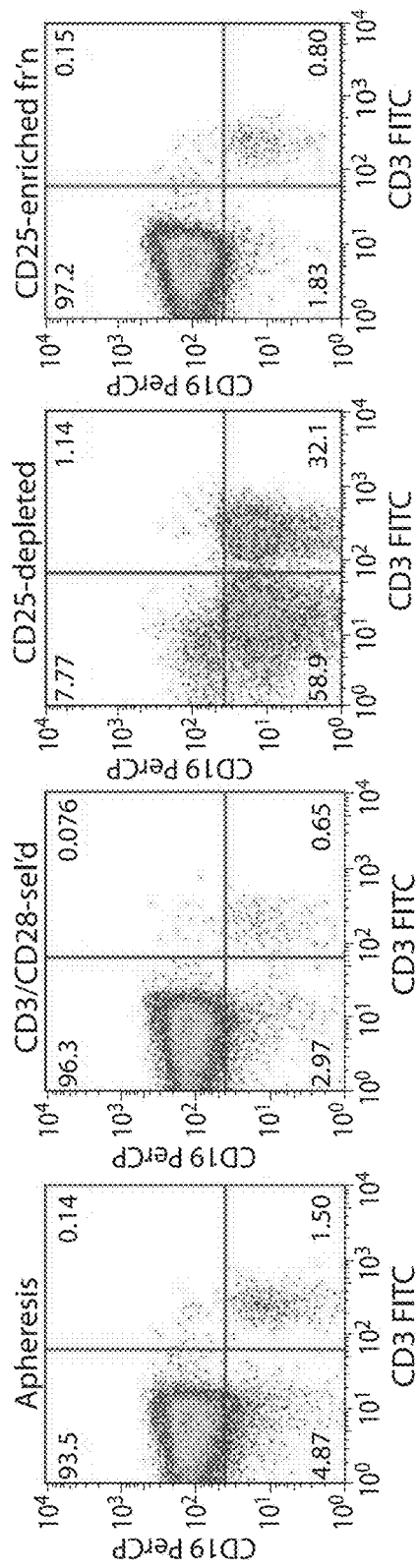
FIG. 9 is a series of FACS plots (top) showing the CD3 and CD19 populations and histograms (bottom) showing CD14 expression of cells from apheresis, cells selected with anti-CD3/CD28, cells depleted for CD25, and the CD25 enriched cells.
Figure 10C:
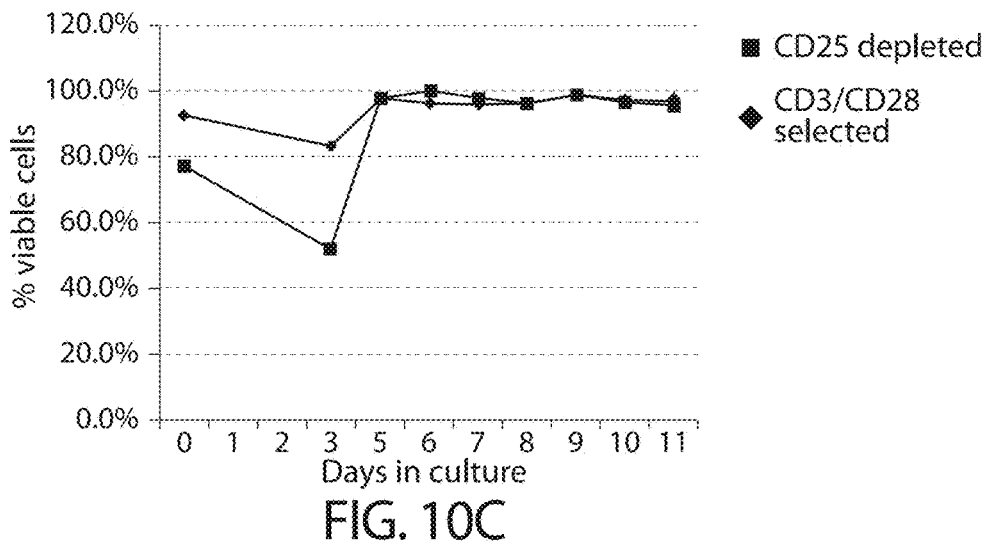

FIG. 9 shows representative flow cytometry analysis plots demonstrating the efficiency of CD25 depletion compared to the total cells from the apheresis, control CD3/CD28 selected cells, CD25 depleted cells, and CD25 enriched cells. The monocyte content of the cell population, as determined by CD14 expression of the CD3–CD19– subset. These results indicate efficient CD25 depletion and that CD25 depletion also resulted in significant monocyte content (61.1% CD14-expressing cells compared to less than 2% in the total cells from apheresis, control, and the CD25 enriched cells.

cells. FIG. 10C shows the percentage of viable cells, and the results show that viability was also similar between control and CD25 depleted cells.

Effect of CD25 Depletion on Lentiviral Transduction Efficiency

The effect of CD25 depletion on lentiviral transduction efficiency was assessed by determining the expression of CAR after transduction. A patient apheresis was depleted with CD25 cells as described above. The efficiency of the CD25 depletion is demonstrated in the flow cytometry analysis plots comparing the CD25-expressing population before (apheresis sample) and after CD25 depletion (CD25-depleleted fraction). After CD25 depletion, the CD25 depleted fraction contained about 59.2% of CD25 negative cells and only 10.3% CD25 positive cells.

The CD25 depleted fraction was transduced with a lentiviral construct encoding CAR19. After 11 days of culture, CAR expression was assessed by flow cytometry. Cells that were untransduced and transduced CD3 selected cells were used as controls. CAR19 expression was significantly higher in CD25 depleted cells compared to CD3 selected cells (51.4% compared to 12.8%). This result demonstrates that CD25 depleted cells have improved lentiviral transduction efficiency, which may be important for improved therapeutic effect in CART therapy.

Example 3: Using Cytokines with CD25-depleted Cells

In this example, the effect of CD25 depletion with cytokine supplement during expansion in culture was examined. Peripheral blood mononuclear cells (PBMCs) were isolated from a patient and were either left unmanipulated or were depleted of CD25-expressing cells as described in Example 2. T cell enrichment was achieved by stimulation with anti-CD3 and CD28 coated beads. The T cells were immediately cultured in media supplemented with 10 ng/ml IL-7, 10 ng/ml IL-15, or the combination of 10 ng/ml IL-7 and 10 ng/ml IL-15. At day 3, medium was changed with the same cytokines added. At day 5, the medium containing 100 IU IL-2/ml was added, and the cells were grown for a total of 10 days.

Figure 11:
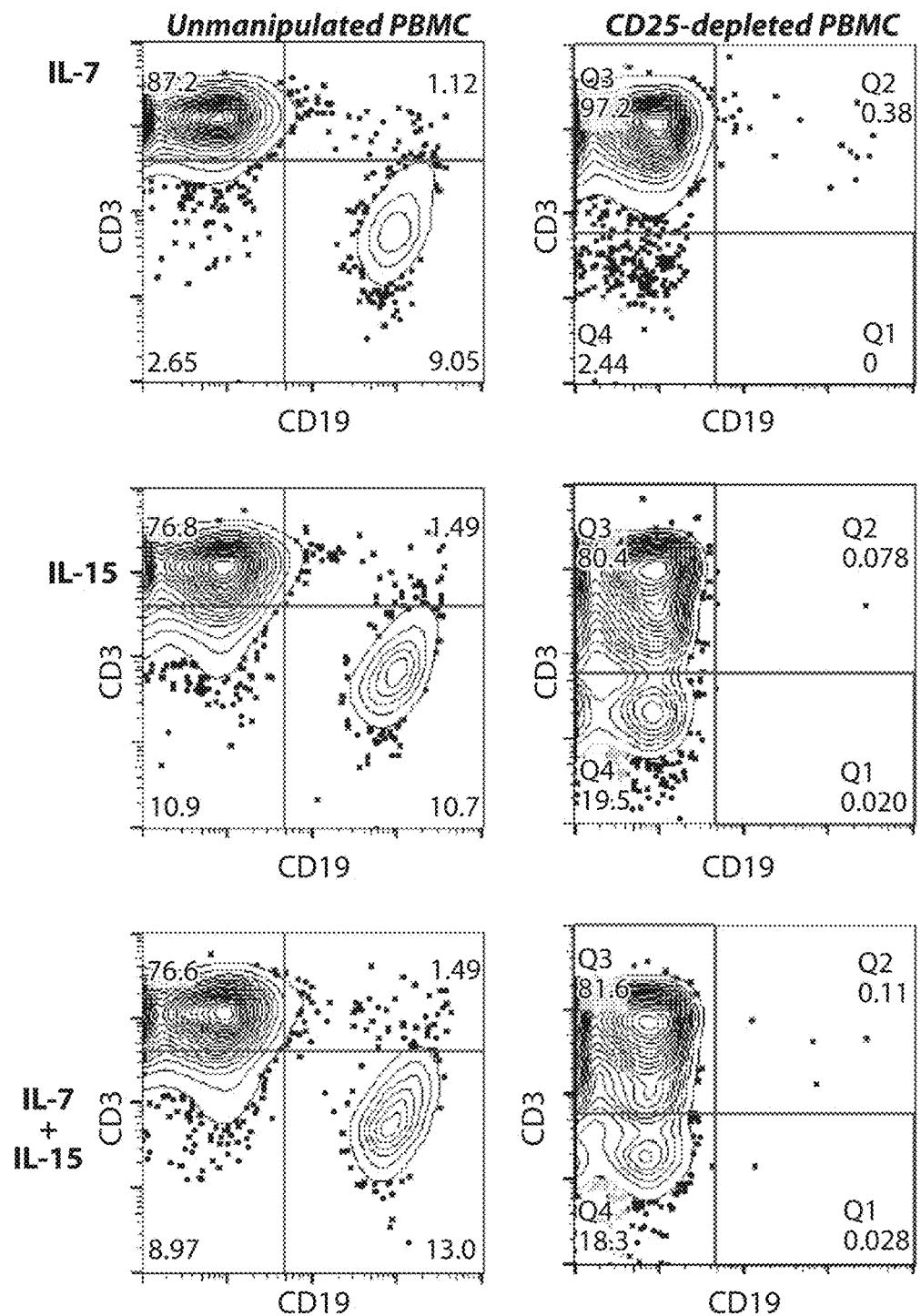
FIG. 11 is a series of FACs plots showing the distribution of CD3 and CD19 in unmanipulated PBMCs and CD25-depleted PBMCs after culture with the indicated cytokine supplements, IL-7, IL-15, or IL-7 and IL-15.
Figure 12:
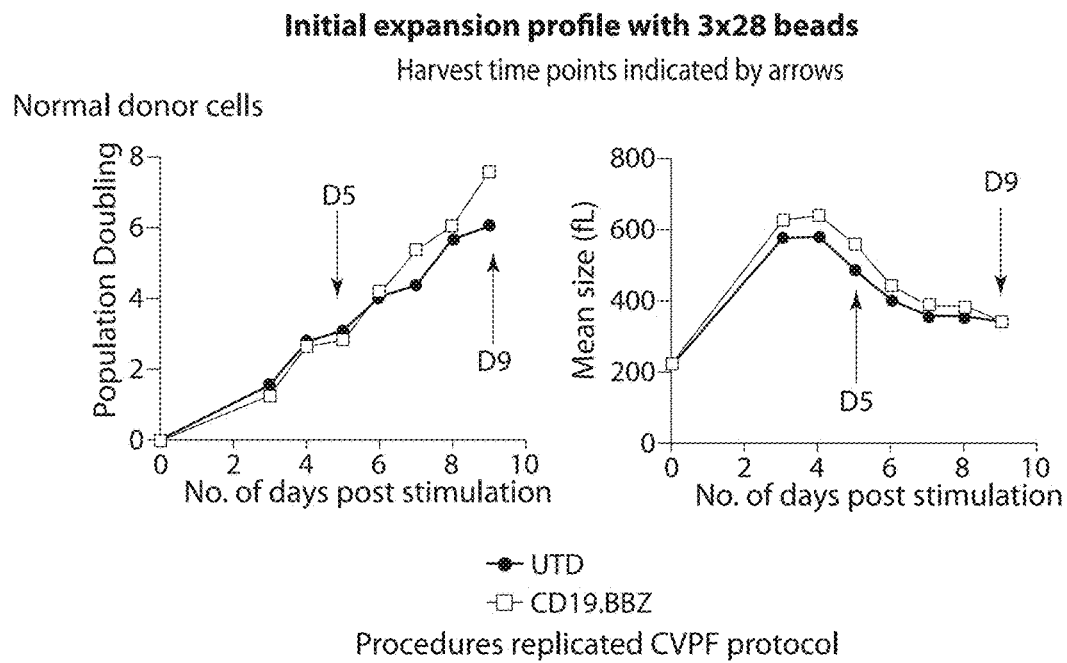
FIG. 12 are graphs showing expansion profile in population doublings (FIG. 17A) and mean size (fL) (FIG. 17B) of PBMCs that have been stimulated with anti-CD3 and CD28 beads, and left either unmanipulated (UTD) or transduced with a CD19 CAR (CD19.BBz), de-beaded, and then harvested at Day 5 and D9.
Figure 13:
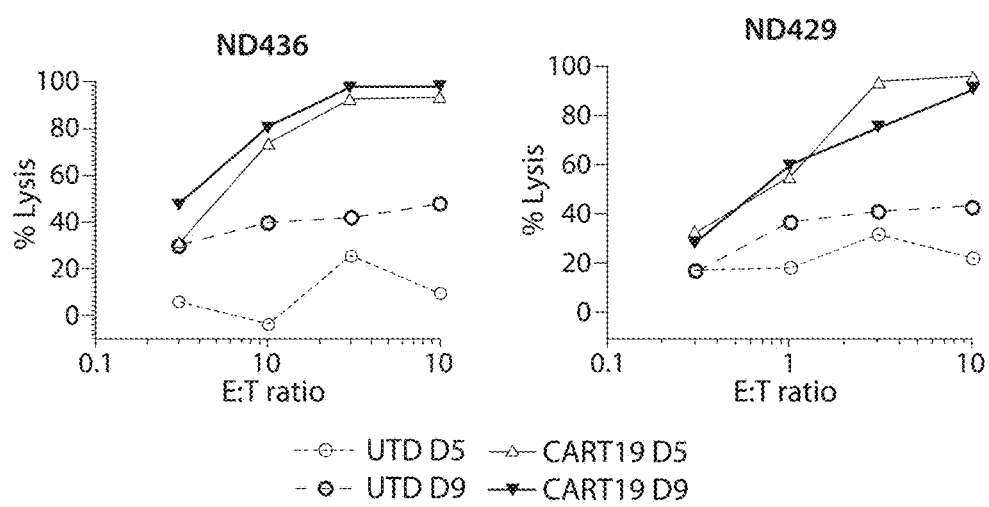
FIG. 13 are graphs depicting cytotoxicity as a percent lysis of CD19 expressing K562 cells treated with PMBCs that have been stimulated with anti-CD3 and CD28 beads, and left either unmanipulated (UTD) or transduced with a CD19 CAR (CD19.BBz), de-beaded, and then harvested at Day 5 and D9.
Figure 14:
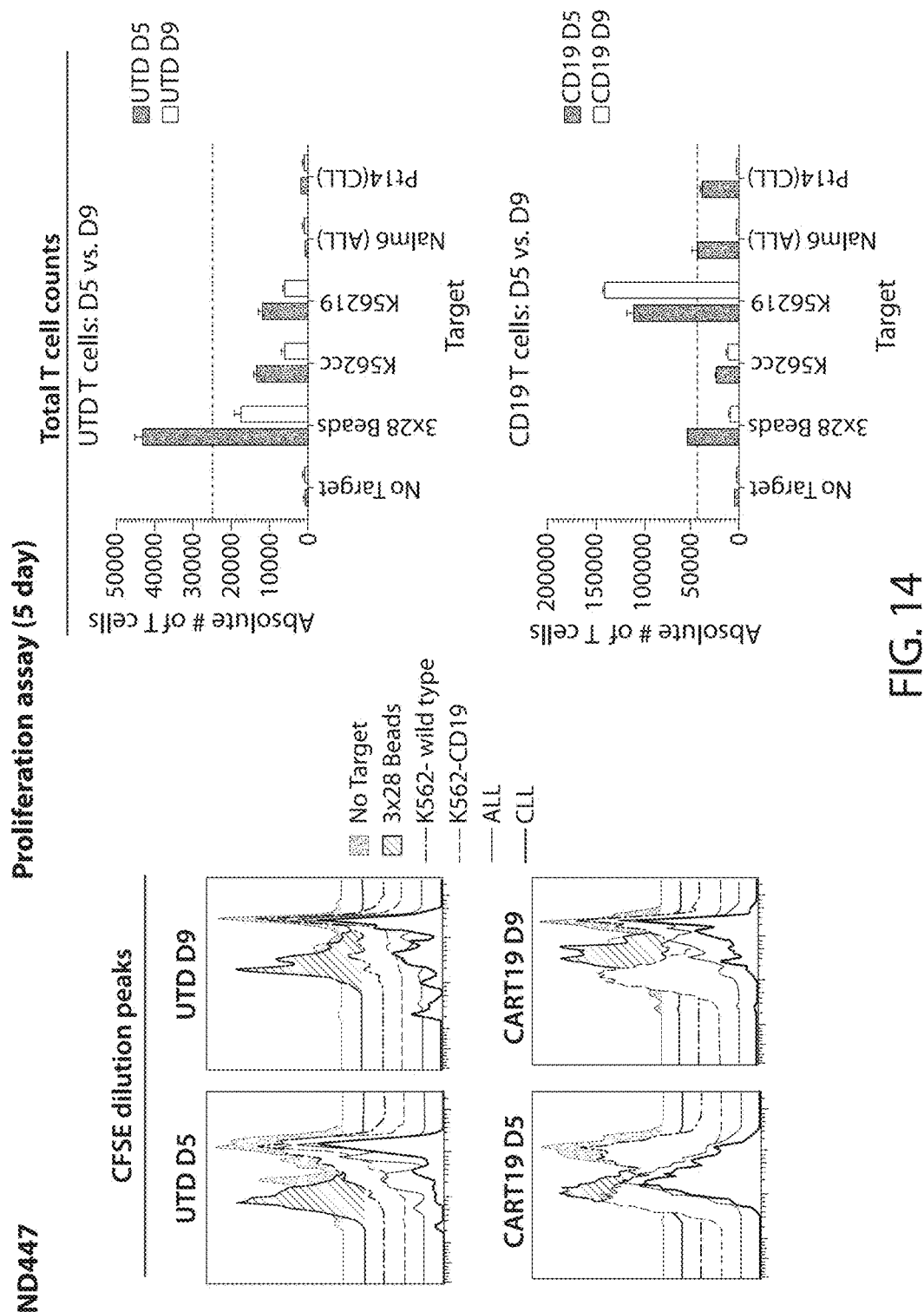
FIG. 14 are graphs depicting proliferation of PBMCs stimulated with anti-CD3 and CD28 beads (3×28 beads), wild type K562 cells, CD19 expressing K562 cells, ALL cells (Nalm6) or CLL cells (P114). The PBMCs have been left either unmanipulated (UTD) or transduced with a CD19 CAR (CART19), de-beaded, and then harvested at Day 5 and D9.
Figure 15:
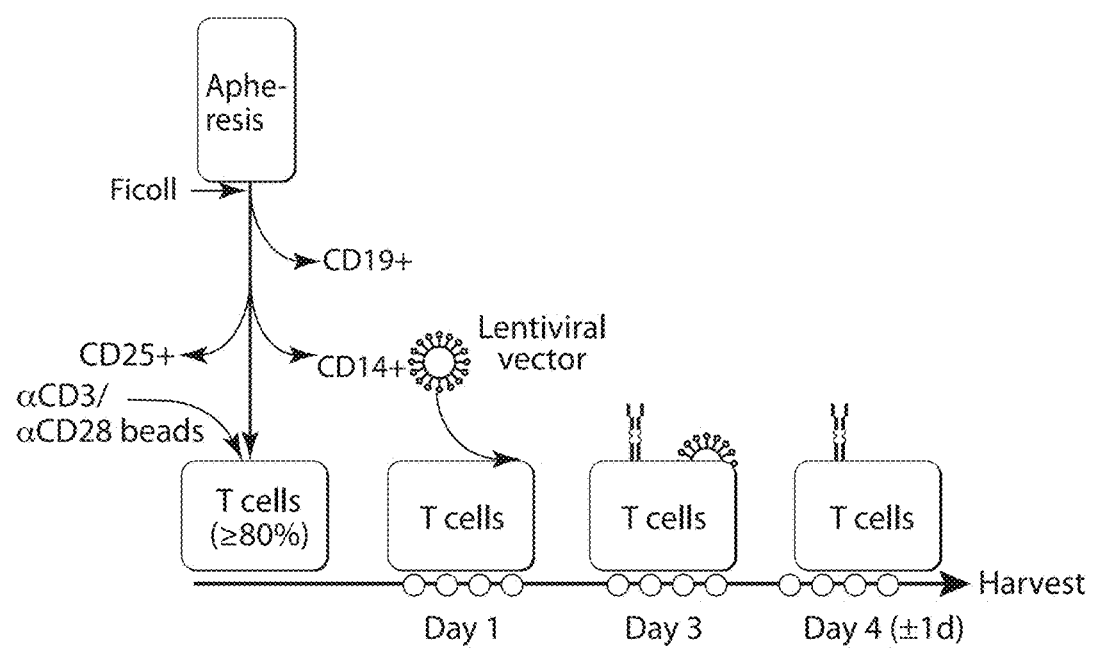
FIG. 15 is a schematic of an exemplary manufacturing scheme.
Figure 16:
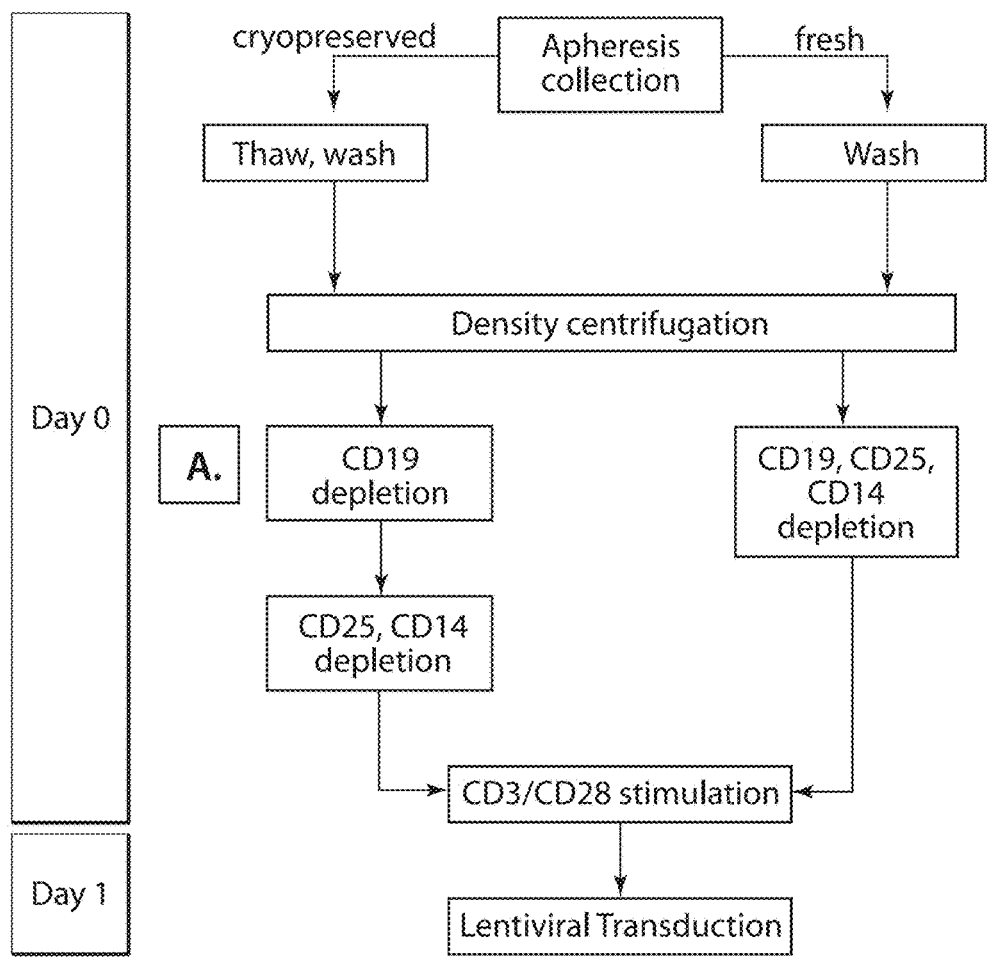
FIG. 16 is a schematic of an exemplary manufacturing scheme.
Figure 17:
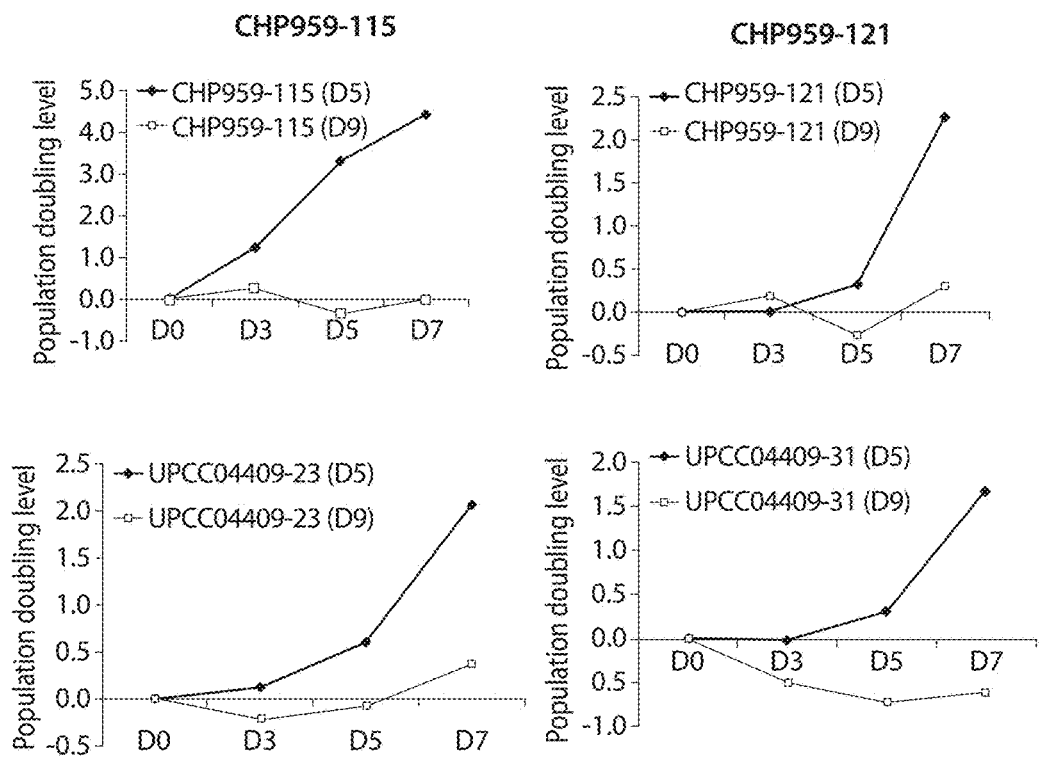
FIG. 17 are graphs depicting the level of cell proliferation of two different manufacturing batches of donor cells transfected with the CTL019 CAR, CHP959-115 and CHP959-121, expanded over a period of 0 to 9 days.
Figure 18:
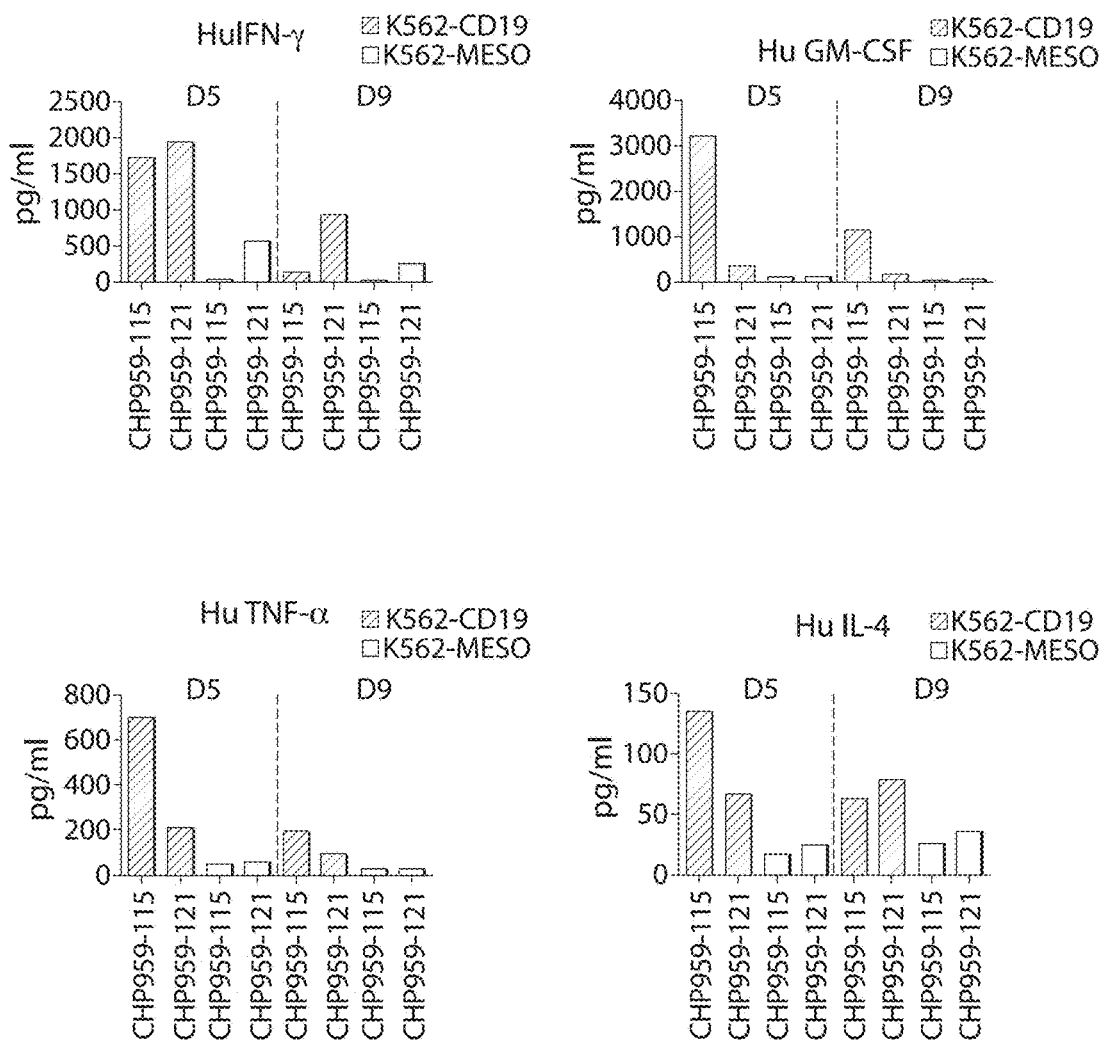
FIG. 18 are graphs showing proinflammatory cytokine production, IFN-γ, GM-CSF, TNF-α and IL-4 of two different manufacturing batches of donor cells transfected with either CTL019 CAR, namely CHP959-115, or an ss1-mesoCAR, namely and CHP959-121, and expanded over a period of 0 to 9 days after apheresis.
Figure 19:
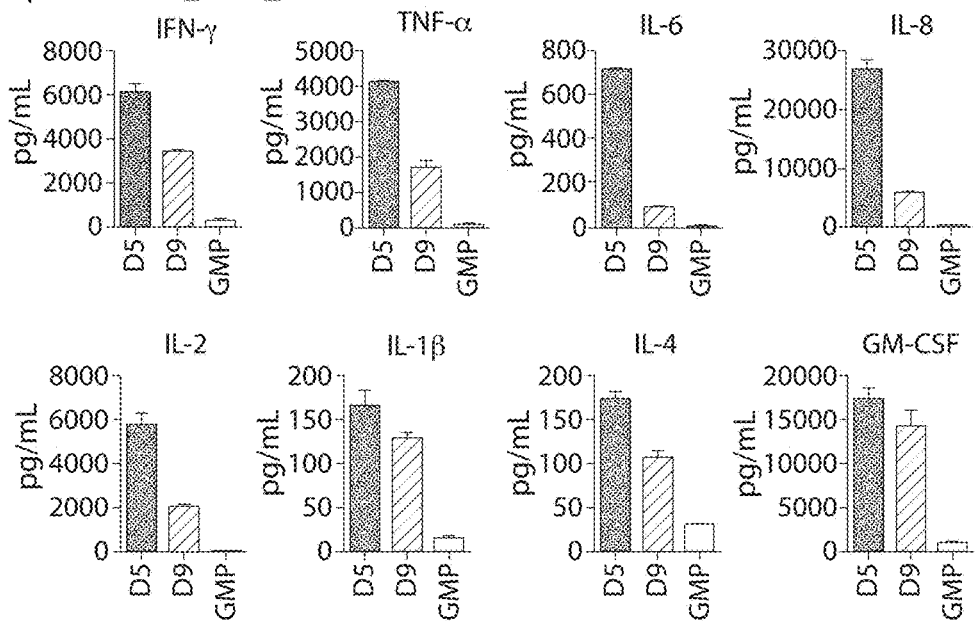
FIG. 19 are graphs depicting production levels IFN-γ, TNF-α, IL-6, IL-8, IL-2, IL-1β, GM-CSF and IL-4 in donor cells stimulated with anti-CAR19-idiotype antibody beads or control beads, transfected with CTL019 CAR and expanded for 5 to 9 days. No cytokine or low cytokine levels (<200 pg/ml) were detected with the control beads.
Figure 20:
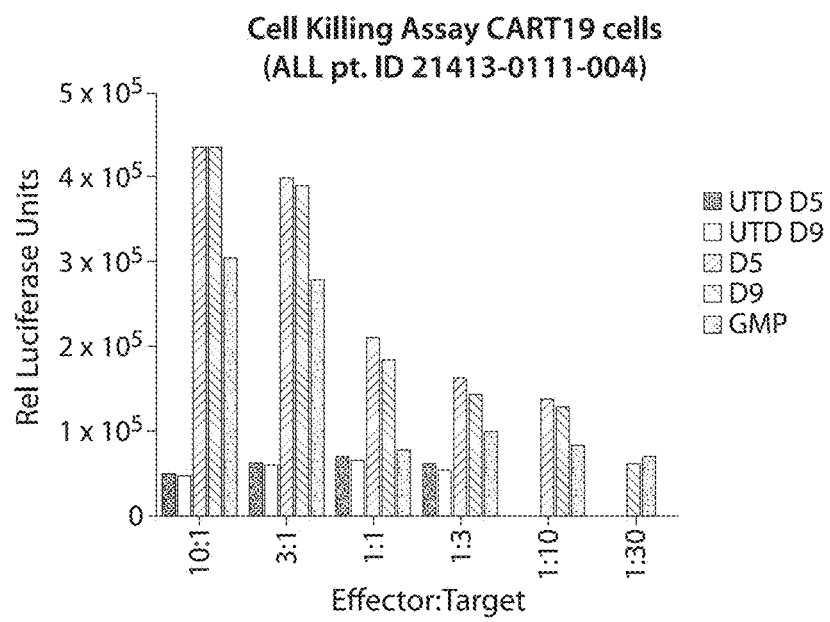
FIG. 20 is a graph depicting cell killing based upon total lysates using a luciferase assay of Nalm6 (ALL) cells of PBMCs left either unmanipulated (UTD) or transduced with a CD19 CAR. (CART19), de-beaded, and then harvested at Day 5 and D9. Various ratios of PMBCs to Nalm6 cells (effector (E):Target (T)) were cultured. As shown CART19 cells harvested at day 5 posses a better killing capacity.
Figure 21:
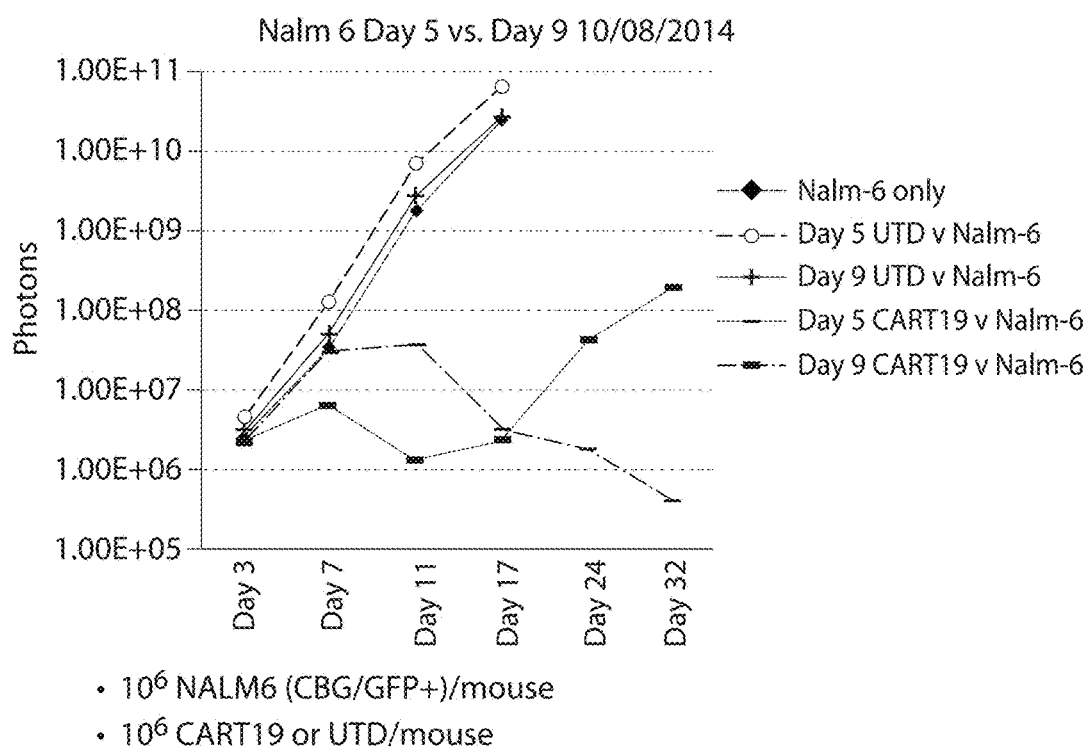
FIG. 21 is a graph depicting long term in vivo killing capacity of PBMCs left either unmanipulated (UTD) or transduced with a CD19 CAR (CART19), de-beaded, and then harvested at Day 5 and D9. The PBMCs were introduced into non-obese diabetic/severe combined immunodeficiency mice inoculated with Nalm6 cells.

Flow cytometric analysis shows the change in distribution of CD3 and CD19 cells in CD25 depleted cells compared to unmanipulated PBMC (standard CD3/CD28 selection) after culture in the presence of IL7, IL-15, or IL7 and IL15. The distribution of CD3, CD19, and CD25 expressing cells in the starting population (e.g., before CD25 depletion and before culture with cytokine supplementation) was assessed. The starting population had a high proportion of CD3–CD19+ cells (~97.2%) and a high proportion of CD25-expressing cells (~94.5% CD25+CD3−; and −93.8% CD25+CD19+). After manipulation (CD25 depletion) and culture with cytokines, the distribution changed as shown in FIG. 11. CD25 depleted cells overall showed greater reduction in CD19-expressing cells compared to the unmanipulated cells.

Proliferation capacity was also assessed for the same cell samples by determining the total number of cells in culture at day 10 after stimulation with anti-CD3 and anti-CD28 coated beads. The cell numbers for each cell sample are shown below.

TABLE 7

| | In vitro expansion | |
|---|---|---|
| Cells | Cytokines added | # Cells in culture |
| Unmanipulated | IL-7 | $1.24 \times 10^6$ |
| | IL-15 | $0.92 \times 10^6$ |
| | IL-7 + IL-15 | $0.52 \times 10^6$ |
| CD25-depleted | IL-7 | $0.93 \times 10^6$ |
| | IL-15 | $1.95 \times 10^6$ |
| | IL-7 + IL-15 | $3.03 \times 10^6$ |

These results show that supplementation of IL-15 during culture of CD25 depleted T cells resulted in increased expansion compared to unmanipulated cells. Addition of IL-7 and IL-15 in the media during culture resulted in significant increase in expansion compared to unmanipulated cells, and compared to adding the cytokines IL-7 or IL-15 independently. Thus, the combination IL-7 and IL-15 supplement resulted in T cells with the most increased proliferation capacity.

Example 4: Stimulation and Expansion of Mesothelin CAR T Cells

Figure 22:
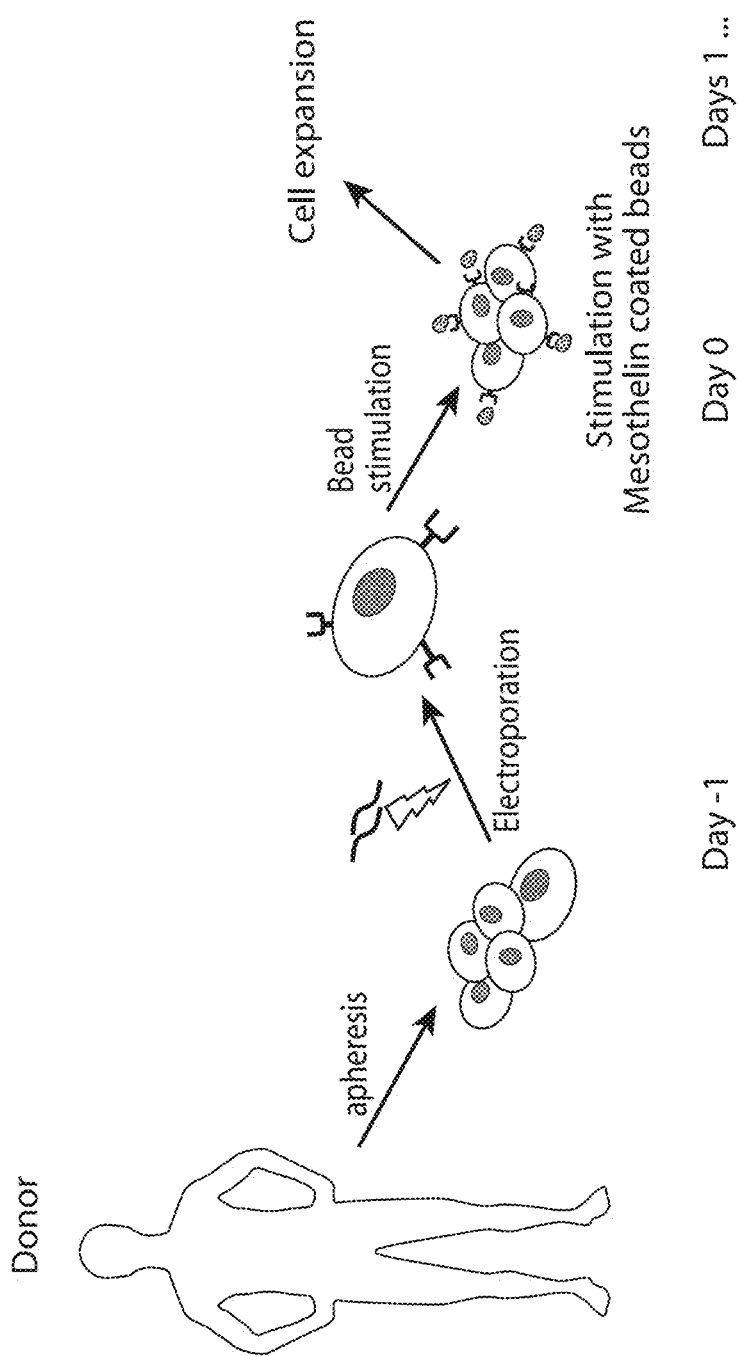
FIG. 22 is a schematic depiction of the use of mesothelin coated beads with mesothelin CARTs for cell expansion.

CD4 or CD8 T cells are obtained from peripheral or cord blood. By means of electroporation, in vitro transcribed RNA is introduced into the cells. After an over-night incubation to allow maximum CAR surface expression, the cells are incubated with a cognate antigen immobilized on to tosylactivated magnetic beads (Invitrogen Cat 14013) in media supplemented by cytokines. The cells are allowed to expand in vitro with regular supplementation of fresh media every 48 hours (FIG. 22).

Figure 23:
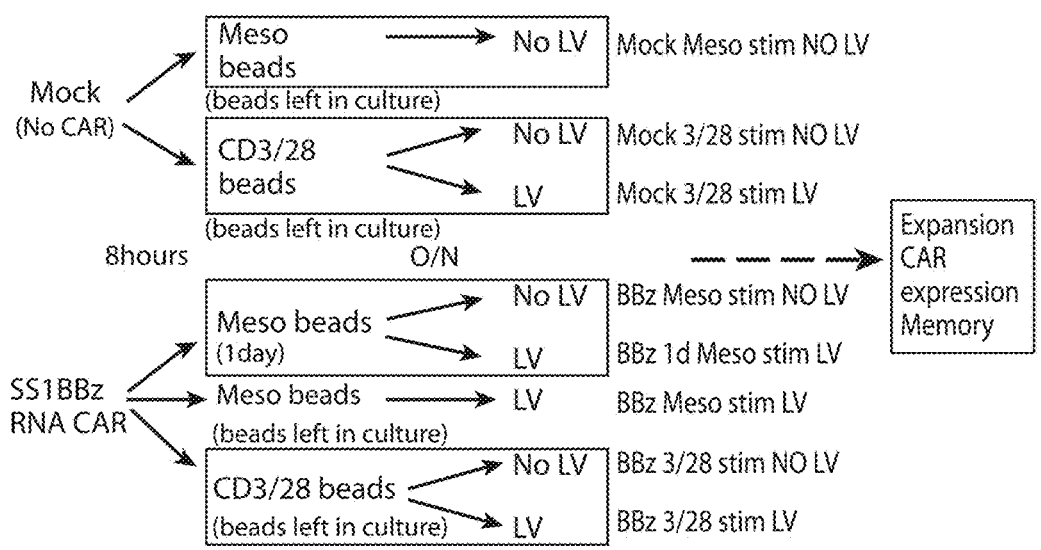
FIG. 23 is a schematic depiction of the study design of Example 4.
Figure 24A:
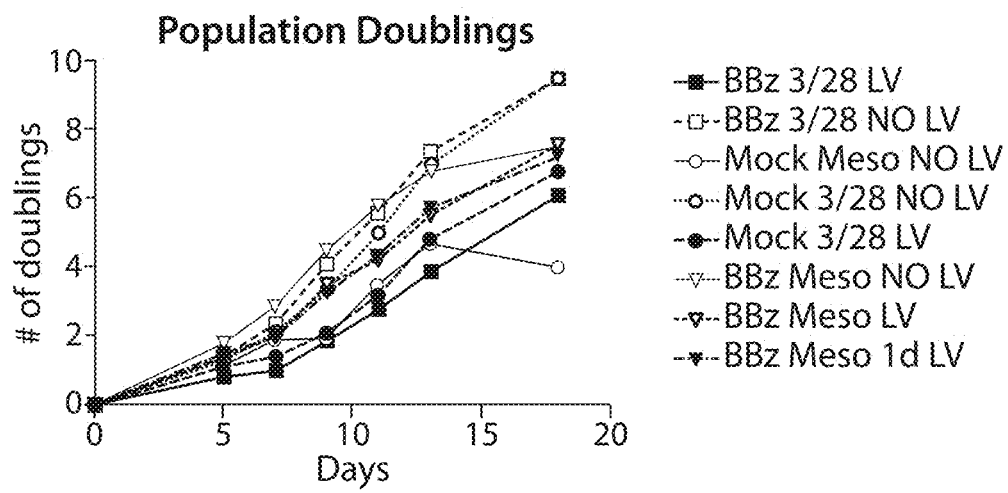
FIGS. 24A and 24B are graphs depicting population doublings (FIG. 24A) and cell size (FIG. 24B) of the cell types shown in FIG. 23.
Figure 24B:
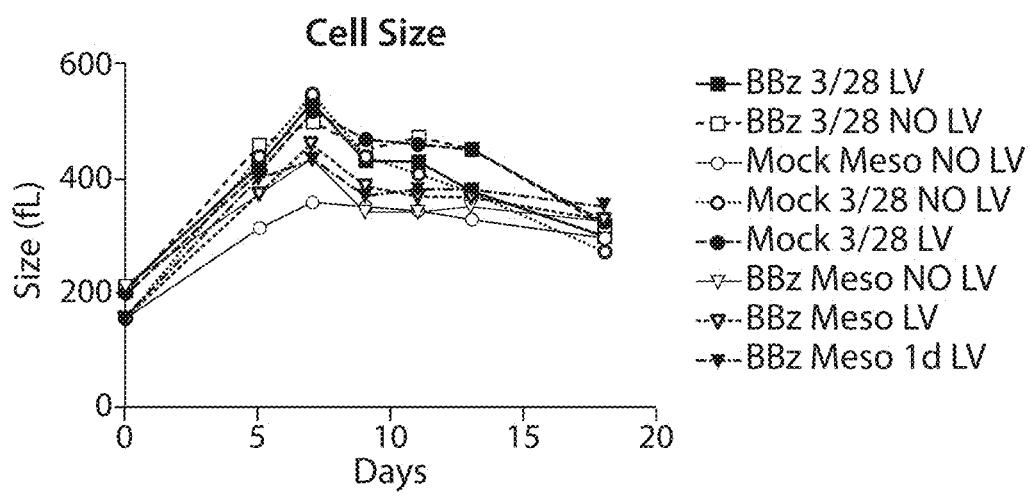
Figure 25A:
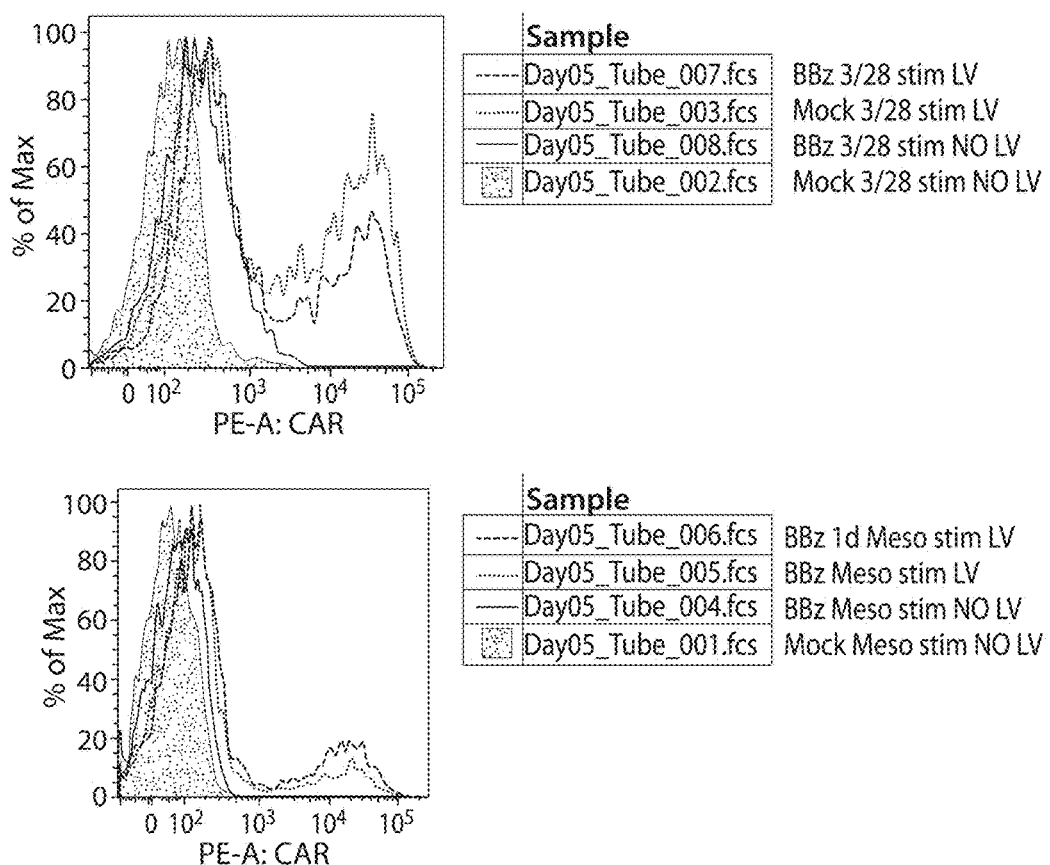
FIGS. 25A and 25B are graphs depicting transduction efficiency after 5 days (FIG. 25A) and 11 days (FIG. 25B).
Figure 25B:
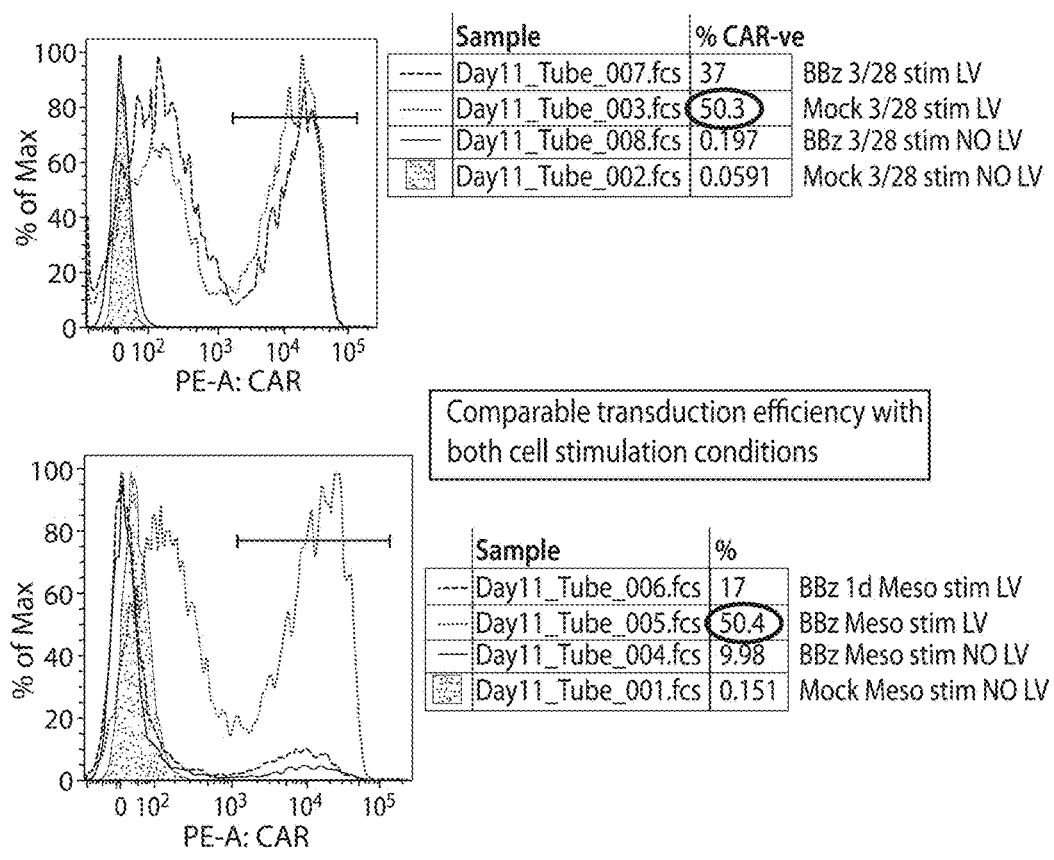

Cultures were started with a 50:50 mix of CD4 and CD8 T cells. Cells were mock electroporated or electroporated with SS1-BBz RNA. After 8 hours, cells were then exposed to mesothelin conjugated beads (left in culture or for 1 day), or CD3/CD28 beads left in culture. The next day the cells were either mock transfected or transfected with lentivirus. (FIG. 23) Growth rate and cell size was measured. Cells stimulated with CD3/28 beads show highest population doublings. However, transduction with lentivirus lowers population by 2 (dark red). (FIG. 24A). Cells pre-electroporated with SS1-BBz RNA show no difference in population doublings and cell size whether stimulated with meso beads for 1 d or more, nor with the transduction with lentivirus. (FIGS. 24A and 24B). Cells stimulated with CD3/28 beads and SS1-BBz CART cells stimulated with mesothelin coated beads showed similar transduction efficiency. (FIGS. 25A and 25B).

Figure 26A:
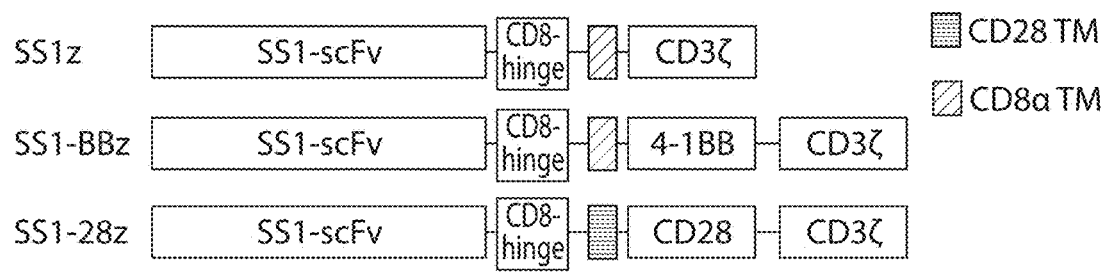
FIGS. 26A and 26B show mesothelin CAR constructs and expression levels.
Figure 26B:
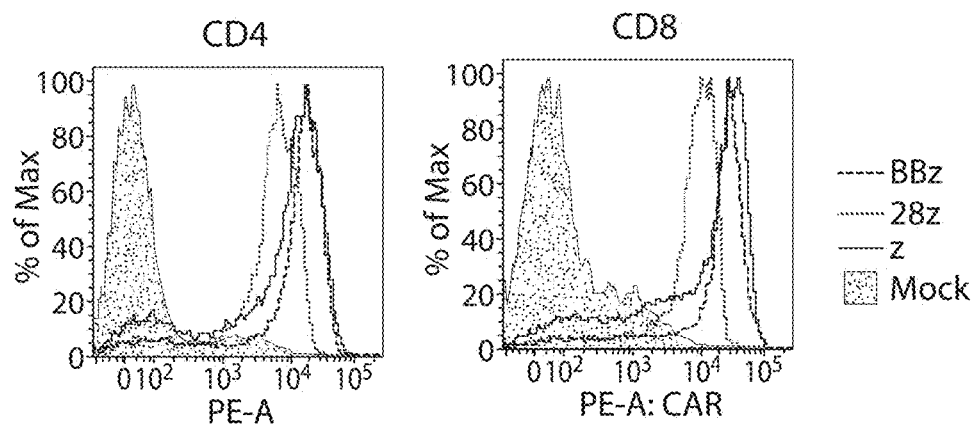

Mesothelin CARs consisting of a single-chain variable fragment (scFv) of the heavy and light chain of an antibody specific to a tumor target protein are shown in FIG. 26A. Although this invention is not restricted to any individual scFv, the results demonstrated here have been obtained, in part, using a mesothelin specific scFv. These CARs have costimulatory domains attached in tandem to the scFv via a CD8z hinge and a transmembrane domain (as shown in the schematic FIG. 26A). Surface expression level of the mesothelin CARs on human CD4 or CD8 T cells is shown in FIG. 26B.

Figure 27A:
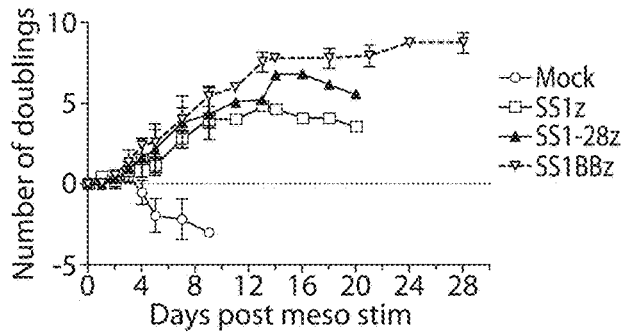
FIGS. 27A-27C shows expansion of peripheral blood T cells and cord blood CD8 T cells in culture through a mesothelin CAR stimulation. CD8 T cells are shown in FIG. 27A. CD4 T cells are shown in FIG. 27B. Cord blood CD8 T cells are shown in FIG. 27C.
Figure 27B:
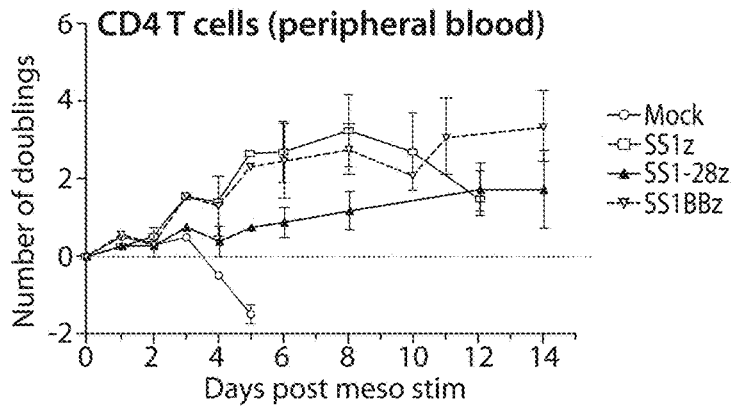
Figure 27C:
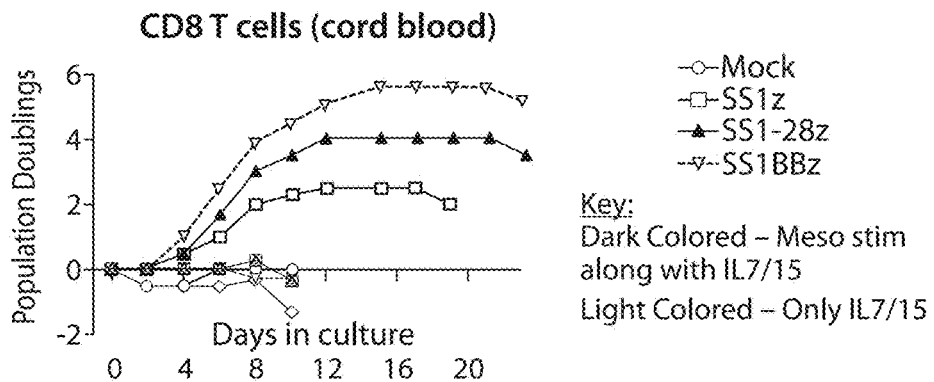

Expansion of peripheral blood CD8 T cells (FIG. 27A) CD4 T cells (FIG. 27B) and cord blood CD8 T cells (FIG. 27C) in culture through mesothelin CAR stimulation was studied. Mesothelin CAR expressing CD4 or CD8 T cells shown were co-cultured with mesothelin immobilized on magnetic beads in the presence of cytokines. CD4 T cells received IL2 (30 units/mL). CD8 T cells were cultured in the presence of either IL2 (100 units/mL) or IL7+IL15 (10 ng/mL each). Cell number was counted (using Multisizer 3 Coulter counter) every 48 hours, and replated at $0.75e^6$/mL with fresh media (supplemented with the corresponding cytokines). All T cells with CARs received CAR-specific stimulation and expanded in culture. Different CAR costimulatory domains had different effects on expansion of T cells in culture, the best combination being the BBz CAR construct in CD8 T cells. These numbers are comparable to the expansions seen using the CD3/28 stimulation conditions.

Example 5: Activation and Expansion of T Cells Via Transiently Expressed Chimeric Antigen Receptors (CARs)

Figure 28:
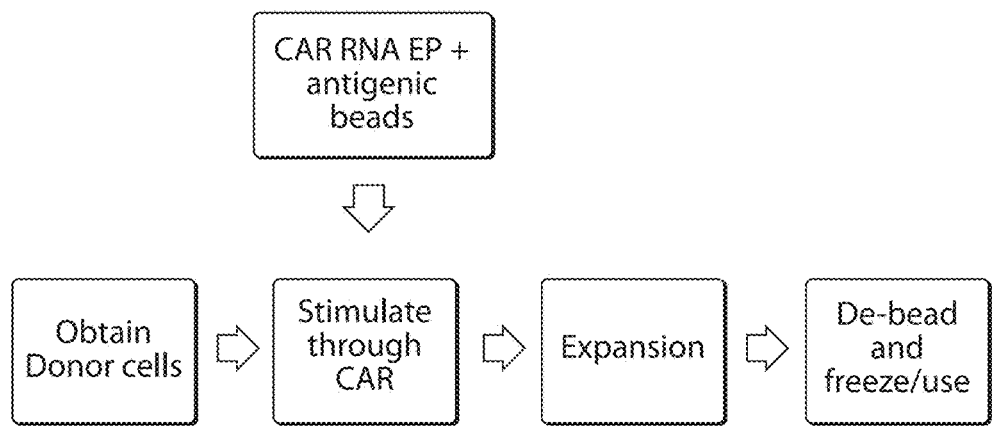
FIG. 28 shows a schematic representation of a method for stimulation through a transiently expressed Chimeric Antigen Receptor (CAR) on the surface of T cells, by its cognate antigen.
Figure 29:
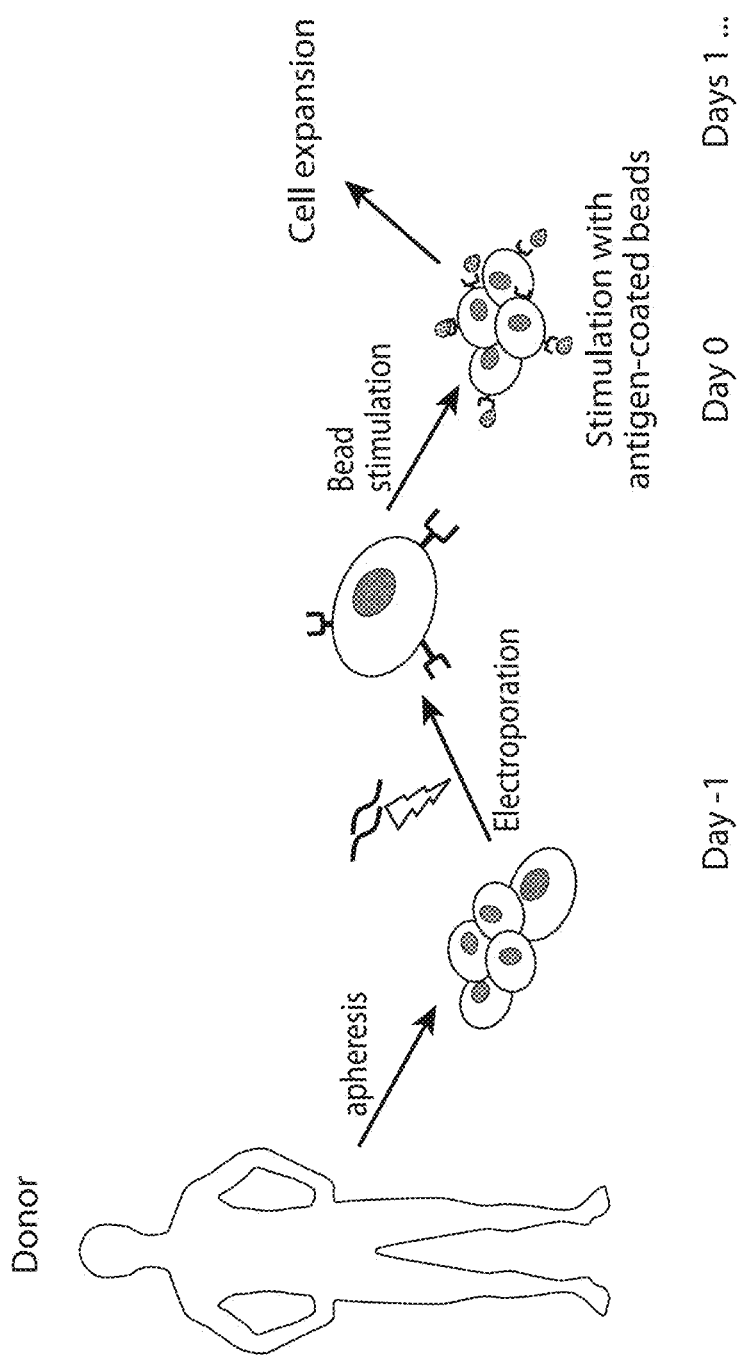
FIG. 29 is a schematic depiction of the use of CARs for cell expansion with beads coated with their cognate antigen.

FIG. 28 shows a schematic representation of a method for stimulation through a transiently expressed Chimeric Antigen Receptor (CAR) on the surface of T cells, by its cognate antigen. CD4 or CD8 T cells are obtained from peripheral or cord blood. By means of electroporation, in vitro transcribed RNA is introduced into the cells. After an over-night incubation to allow maximum CAR surface expression, the cells are incubated with a cognate antigen immobilized onto tosylactivated magnetic beads (Invitrogen Cat 14013) in media supplemented by cytokines. The cells are allowed to expand in vitro with regular supplementation of fresh media every 48 hours. (FIG. 29)

Figure 30A:
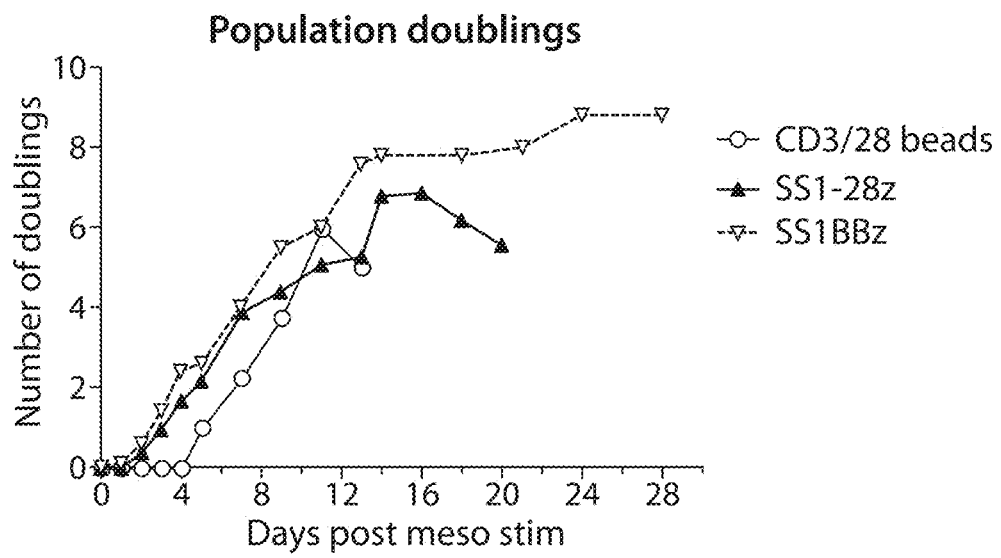
FIGS. 30A and 30B are graphs depicting population doublings (FIG. 30A) and cell size (FIG. 30B) of mesothelin CAR expressing cells after exposure to mesothelin coated beads.
Figure 30B:
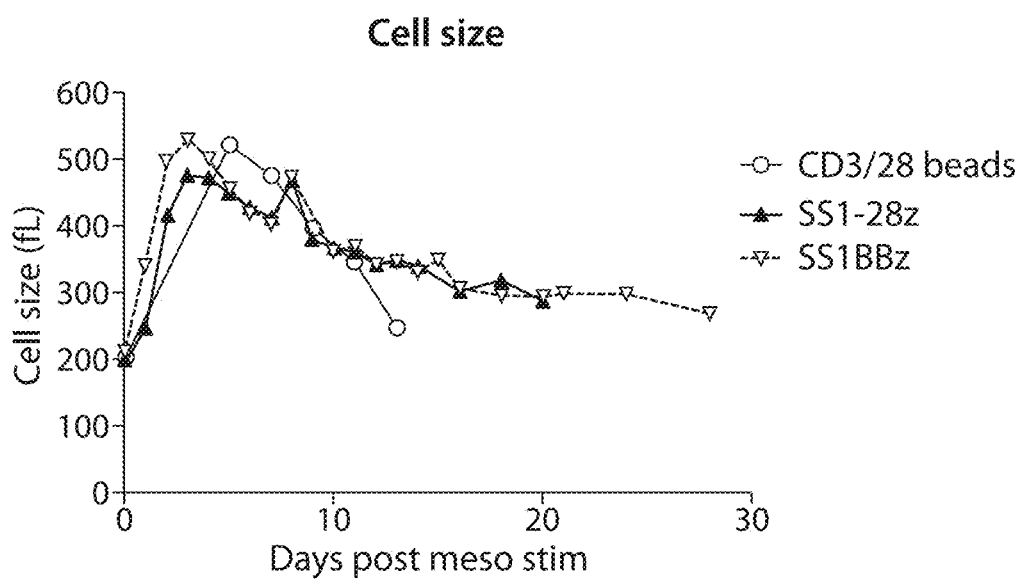
Figure 31A:
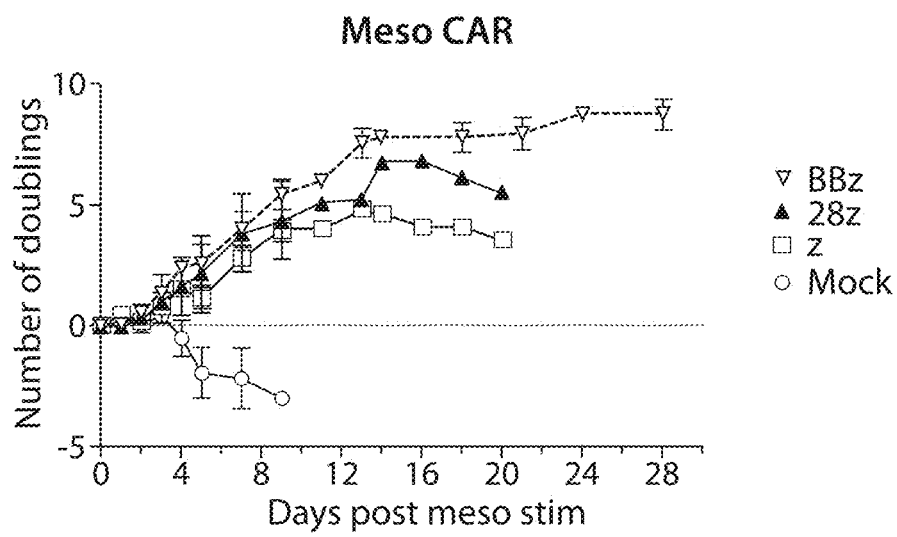
FIGS. 31A-31C is a graph demonstrating expansion of peripheral blood T cells stimulated with mesothelin CAR (FIG. 31A), or CD19 CAR (FIG. 31B) and cord blood CD8 T cells stimulated with mesothelin CAR (FIG. 31C) in culture.
Figure 31B:
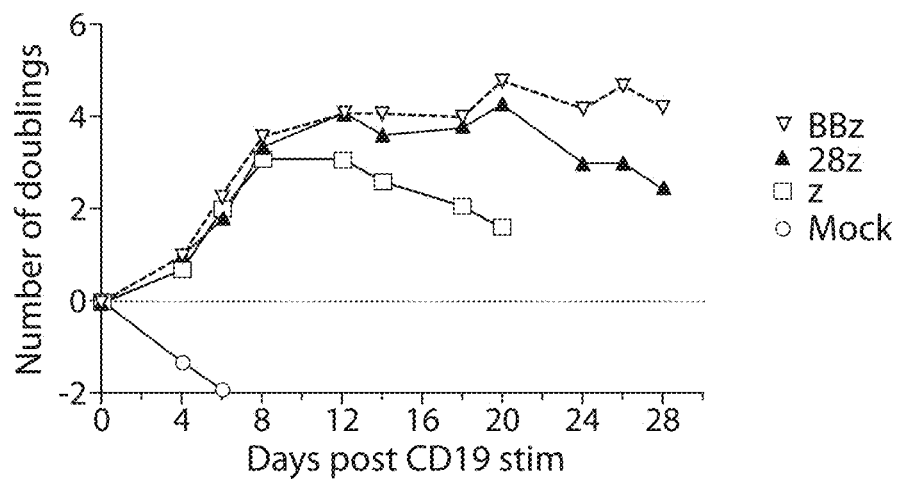
Figure 31C:
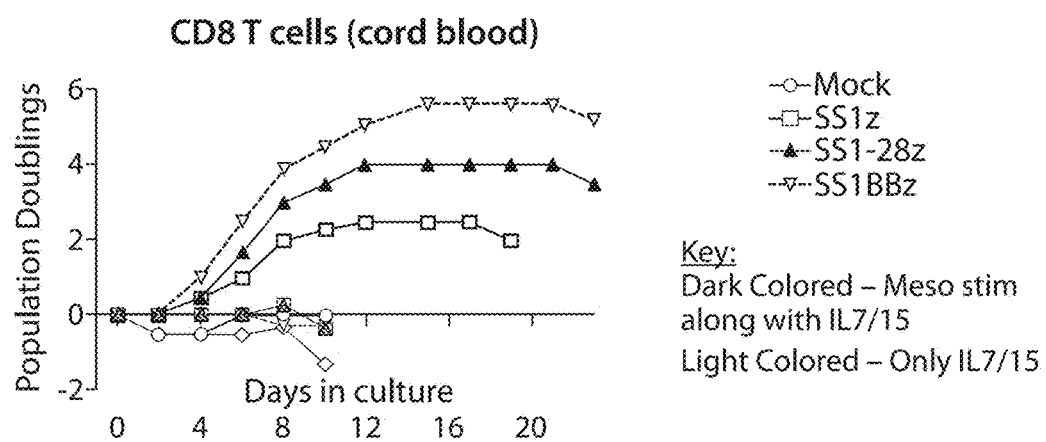

Population doublings (FIG. 30A) and cell size (FIG. 30B) of mesothelin CAR expressing cells after exposure to mesothelin coated beads were measured as well as expansion of peripheral blood T cells stimulated with mesothelin CAR (FIG. 31A), or CD19 CAR (FIG. 31B) and cord blood CD8 T cells stimulated with mesothelin CAR (FIG. 31C) in culture. CAR expressing T cells were co-cultured with CAR-specific antigen immobilized on magnetic beads in the presence of cytokines. CD8 T cells were cultured in the presence of IL7+IL15 (10 ng/mL each). Cell number was counted (using Multisizer 3 Coulter counter) every 48 hours, and replated at $0.75e^6$/mL with fresh media (supplemented with the corresponding cytokines).

All T cells with CARs received CAR-specific stimulation and expanded in culture. Different CAR costimulatory domains had different effects on expansion of T cells in culture, the best combination being the BBz CAR construct in CD8 T cells. These numbers are comparable to (and in some cases, higher than) the expansions seen using the CD3/28 stimulation conditions.

Example 6: Reprogramming Metabolic Fate of T Cells by Distinct Signaling Domains in Chimeric Antigen Receptors Chimeric antigen receptors (CAR) redirect T cell cytotoxicity against cancer cells, providing a promising new approach to cancer immunotherapy. Despite extensive clinical use, the attributes of CAR co-stimulatory domains that impact persistence and functions (e.g., resistance to exhaustion) of CAR-T cells remain largely undefined. This example reports the influence of signaling domains of coreceptors CD28 and 4-1BB on proliferation, cell longevity, memory differentiation and metabolic characteristics of CAR-grafted human T cells. Inclusion of 4-1BB, a member of the TNF receptor family in the CAR architecture, promotes the outgrowth of CD8 central memory T cells that had significantly enhanced respiratory capacity, increased fatty acid oxidation and enhanced mitochondrial biogenesis. In contrast, CAR T cells with CD28 domains yielded effector memory cells with a genetic signature consistent with enhanced glycolysis. These results provide, at least in part, a mechanistic insight into the differential persistence of CAR-T cells expressing 4-1BB or CD28 signaling domains in clinical trials and inform the design of future CAR T cell therapies.

Adoptive immunotherapy based on the infusion of genetically redirected autologous T cells has demonstrated promise for the treatment of both hematologic malignancies and solid tumors. Accordingly, multiple gain-of-function strategies to endow T cells with desired antigen receptors, based on either T cell receptors (TCRs) or chimeric antigen receptors (CARs) have been described (June et al., Sci. Transl. Med. 7, 280ps 7, 2015). Among several proposed strategies, the use of CARs has shown potent effects in augmenting immune response to cancers, particularly B cell malignancies (Brentjens et al., Sci. Transl. Med. 5, 177ra38, 2013; Grupp et al., N. Engl. J. Med. 368, 1509-1518, 2013; Kalos et al., Sci. Transl. Med. 3, 95ra73, 2011). Although CAR T cell therapy can have a significant impact on disease clearance, the essential components of a clinically successful CAR, and how they influence therapeutic efficacy, remain largely undefined (Kalos and June, Immunity 39, 49-60, 2013).

CARs are synthetic molecules that combine the effector functions of T cells with the exquisite specificity of antibody-binding domains. In their simplest form, these receptors consist of the TCR grafted to extracellular variable regions of an antibody (Eshhar et al., Proc. Natl. Acad. Sci. USA 90, 720-724, 1993; Kuwana et al., Biochem. Biophys. Res. Commun. 149, 960-968, 1987). One advantage of antibody-based receptors is that they can recognize predefined tumor targets independent of antigen processing and major histocompatibility complex (MHC)-restricted presentation, rendering a single design applicable to a wide range of patients. First-generation CARs consisting of the cytoplasmic domain of the Fc receptor-gamma chain (g chain) or the CD3z signaling modules alone often become anergic and do not elicit potent T cell antitumor effects (Brocker, Blood 96, 1999-2001, 2000; Kershaw et al., Clin. Cancer Res. 12, 6106-6115, 2006; Lamers et al., J. Clin. Oncol. 24, e20-e22, 2006). This led to the development of second- and third-generation CARs that incorporate additional costimulatory cytoplasmic domains such as CD28, 4-1BB (CD137), ICOS, and OX40, either individually or in combination (Dotti et al., Immunol. Rev. 257, 107-126, 2014; Sadelain et al., Cancer Discov. 3, 388-398, 2013). This modular design successfully recapitulates many aspects of natural costimulation and enhances proliferation and function of CAR T cells (Maus et al., Cancer Immunol. Res. 1, 26-31, 2014).

The CD19-specific CAR T cells have shown encouraging clinical responses against various hematological malignancies, including chronic lymphocytic leukemia (CLL), acute lymphoblastic leukemia (ALL) and diffuse large B cell lymphoma. The success rates, however, have been difficult to compare because of several variations in study design, as well as differences in the single chain variable antibody fragment (scFv), costimulatory domains, gene-transfer protocols and interventions following CAR T cell infusion, among others. Trials conducted with CARs incorporating CD28 or 4-1BB costimulatory domains have shown similar initial response rates in patients with ALL (Brentjens et al., Sci. Transl. Med. 5, 177ra38, 2013; Lee et al., Lancet 385, 517-528, 2015; Maude et al. N. Engl. J. Med. 371, 1507-1517, 2014). However, in CLL the clinical efficacy of CART cells with 4-1BB costimulatory domains (Porter et al., Sci. Transl. Med. 7, 303ra139, 2015) appears superior to that of CD28 domains (Brentjens et al., Blood 118, 4817-4828, 2011 Porter et al., Sci. Transl. Med. 7, 303ra139, 2015). The reported persistence of CD28 based CAR T cells in vivo is about 30 days (Brentjens et al., Sci. Transl. Med. 5, 177ra38, 2013; Lee et al., Lancet 385, 517-528, 2015), compared to the sustained expression and effector function of 4-1BB CAR T cells, which may exceed 4 years in some patients (Porter et al., Sci. Transl. Med. 7, 303ra139, 2015). In addition, the incorporation of 4-1BB signaling domains in certain CARs ameliorates exhaustion (Long et al., 2015). Another important consideration is that endogenous CD28 and members of the tumor necrosis factor receptor family (TNFR), such as 4-1BB, invoke distinct signaling cascades in T cells. CD28 leads to activation of the P13K-Akt pathway with downstream effects on glucose metabolism and increased glycolysis (Frauwirth et al., Immunity 16, 769-777, 2002). In contrast, endogenous 4-1BB signaling has been implicated in imparting long-term survival benefits to T cells (Sabbagh et al., J. Immunol. 180, 8093-8101, 2008) and signaling pathways used by 4-1BB are distinct from CD28 (Martinez-Forero et al., J. Immunol. 190, 6694-6706, 2013). Thus, a thorough understanding of the molecular signaling effects of CARs may in part explain the observed differences in clinical efficacy for CLL.

A challenge for the identification of optimal CAR designs has been the lack of a physiological in vitro model investigating the impact of CAR-based stimulation. Moreover, current gene transfer protocols with retroviruses require concomitant activation of T cells via its endogenous TCR, potentially obscuring effects due to signaling through the CAR per se. In this Example, an approach is described allowing for CAR expression in over 90% of the T cells without the need to activate the endogenous TCR. Stimulating the CAR T cells with cognate antigen permitted identification of distinct effects on the differentiation and metabolism of primary human T cells. It was found that CAR signaling domains can mediate metabolic reprogramming while modifying bioenergetics and mitochondrial biogenesis. It was found that 4-1BBz CAR T cells demonstrate enhanced survival associated with an increased frequency of central memory T (Tcm) cells, mitochondrial biogenesis, and greater oxidative metabolism. In contrast, antigen stimulation of CD28z CAR T cells promoted effector memory differentiation and led to enhanced aerobic glycolysis.

As described in this example, distinct signaling of coreceptors can regulate specific metabolism pathways and impact memory development in CAR T cells.

Experimental Procedures

CAR Constructs and Generation of CAR-Encoding In Vitro Transcribed (IVT) RNA

Figure 32A:
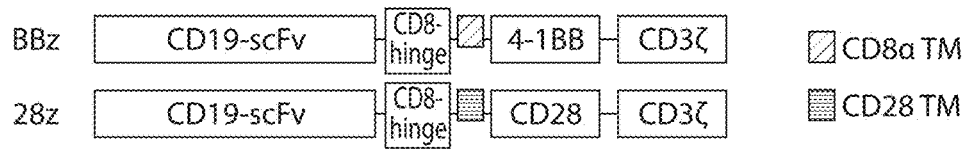
FIGS. 32A-32C show CAR constructs and study design of example 6.

For the purpose of these studies, CARs specific to the human CD19 or mesothelin antigen were used. FIG. 32A shows the schematic of the CARs used in this study. All CARs contained the single-chain variable fragment (scFv) against human CD19 (clone FMC-63), or the SS1 scFv against human mesothelin protein, wherever indicated (Hassan et al., Clin. Cancer Res. 8, 3520-3526, 2002; Nicholson et al., Mol. Immunol. 34, 1157-1165, 1997). The mesothelin CAR was previously described (Carpenito et al., Proc. Natl. Acad. Sci. USA 106, 3360-3365, 2009). The CD28z CAR consisted of the scFv linked in cis to the intracellular domains of CD28 and CD3z through the CD8a hinge and a CD28-transmembrane domain, as described previously (Milone et al., Mol. Ther. 17, 1453-1464, 2009). Similarly the BBz CAR contained the scFv linked to the 4-1BB intracellular portion and the CD3z domain through a CD8a hinge and transmembrane domain (Milone et al., Mol. Ther. 17, 1453-1464, 2009). For preparation of in-vitro-transcribed (IVT) RNA, the CAR-encoding gene constructs were subcloned into the pGEM.64A based vector, as described previously (Zhao et al., Cancer Res. 70, 9053-9061, 2010).

CAR RNA Preparation

For in vitro transcribed (IVT) RNA, the T7 mScript™ RNA system (Cellscript, Madison Wis.) was used as per the manufacturer's instructions and as described previously (Zhao et al., Cancer Res. 70, 9053-9061, 2010). The IVT products were purified with an RNeasy Mini Kit (Qiagen Inc., Valencia, Calif.) and the purified RNA was eluted in RNase-free water at 1 µg/µL.

Isolation, Electroporation and Expansion of Primary Human T Lymphocytes

Figure 32B:
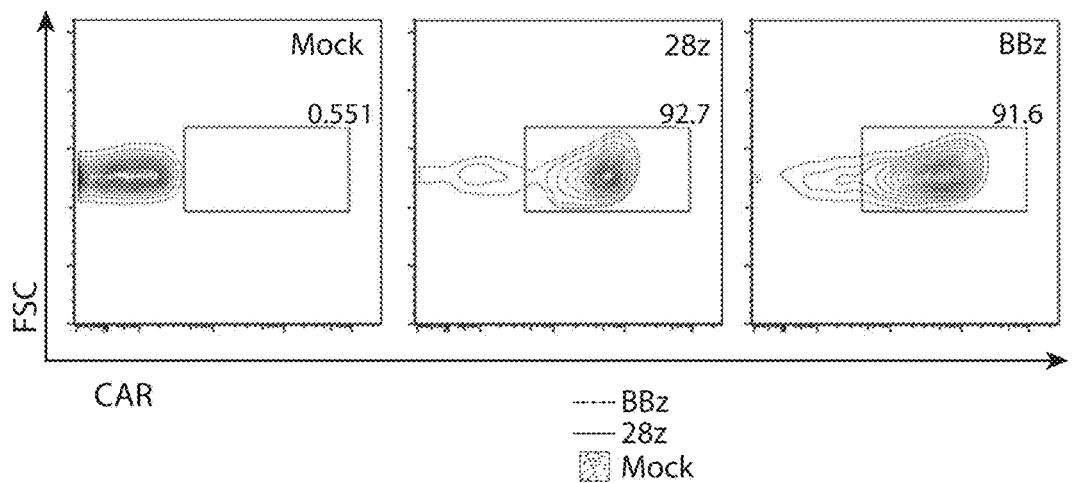
Figure 32B:
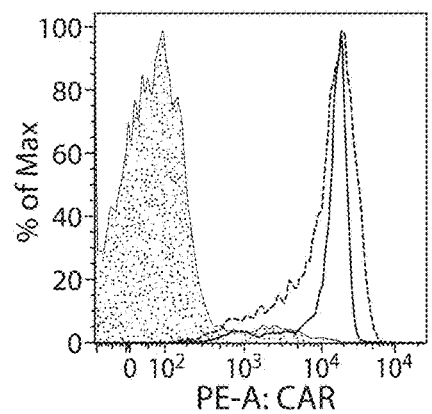

Primary human T lymphocytes were obtained from anonymous healthy donors at the University of Pennsylvania Apheresis Unit. Using the BTX CM380 (Harvard Apparatus BTX) electroporation machine, the IVT RNA was introduced into the T cells at a ratio of 1 ug RNA/$10^6$ cells. This technique was optimized to promote uniform CAR expression on the cell surface (FIG. 32B). T cells were stimulated with magnetic beads coated with a recombinant anti-CD19 idiotype or mesothelin-Fc.

Preparation of Stimulation Beads

For in vitro stimulation of CAR T cells, recombinant anti-CD19 idiotype antibody or mesothelin-Fc fusion protein was coupled to Dynabeads M-450 Tosylactivated (Invitrogen, USA). For the coupling, every $4\times10^8$ beads were washed once and resuspended in 1 mL of sterile Borate solution (0.1M Boric acid, pH 9.5). To this, 150 µg of protein in 1 mL of Borate solution was added and incubated overnight (16-24 hours) at 37° C. with constant mixing. After magnet bead capture, the solution was decanted and the beads were washed three times with Bead-wash solution (3% human albumin, 0.1% sodium azide and 0.4% 0.5M EDTA in PBS) for 10 minutes each time, and then another overnight wash in fresh Bead-wash solution with continuous rocking. The coated beads were washed three times in R10 (RPMI supplemented with 10% FCS, 100-U/ml penicillin, 100 m/ml streptomycin sulfate) before use for in vitro stimulation. For stimulation, the CAR RNA-electroporated cells were co-cultured with beads in a bead:cells ratio of 3:1.

T Cell Culture

The cells were maintained in R10 at 37° C. for the entire culture and fed with fresh media every 48 hours. The cells were counted using a Coulter Multisizer III particle counter. Population doubling for each time point was measured as a ratio of the total cells on the day to the last time point measured. Cumulative population doublings were plotted. The media was supplemented with cytokines as follows: for CD4+ T cells 30 U/mL human IL2 (Chiron) and for CD8+ T cells 10 ng/mL IL7+10 ng/mL IL15 (R&D systems).

Surface Staining for Flow Cytometry Analysis

Cell viability was measured by staining with Live/Dead Fixable Aqua amine-reactive viability dye (Life Technologies) for 15 minutes at room temperature. The following fluorescent probe conjugated antibodies were purchased from BD Biosciences: αCD4-BV711, αCD8-APCH7, αCD45RO-PE, αCD69-PECF594, αCCR7-PE-Cy7, αCD25–PE-Cy7, αCD127-FITC and αCD215-PE. Surface staining was performed at 4° C. for 30 minutes in phosphate-buffered saline (PBS) supplemented with 3% fetal bovine serum. Surface expression of CAR was examined by incubating cells with biotin-labelled polyclonal goat anti-mouse F(ab)2 antibodies (Jackson Immunoresearch, West Grove, Pa.) at 4° C. for 30 minutes, followed by two washes with FACs buffer (PBS plus 3% BSA) and detection with phycoerythrin-labeled streptavidin (BD Pharmingen, San Diego, Calif.). Sample data was collected on the LSRII Fortessa (BD Biosciences) and analyzed with FlowJo software (Treestar).

Flow Cytometry Analysis

Live cells were gated on live/dead aqua-negative and then gated for CD3-, CD4-, and CD8-positive events. Using markers for memory, CCR7, and CD45RO, we analyzed cells in culture and sorted them for the three different memory phenotypes using the BD FACSCalibur analyzer. Absolute T cell counts were determined with the aid of CountBright Absolute Counting Beads (Life Technologies) using the following formula: (Number of T cells events/number of bead events)×number of beads used Analysis of Metabolic Parameters Mitochondrial function was assessed with an extracellular flux analyzer (Seahorse Bioscience). Individual wells of an XF24 (FIGS. 34B-34C and 34F-34G) or XF96 (FIGS. 34H-34K) cell culture microplates were coated with CellTak in accordance with the manufacturer's instructions. The matrix was adsorbed overnight at 37° C., aspirated, air-dried, and stored at 4° C. until use. Mitochondrial function was assessed on days 0, 7, and 21. To assay mitochondrial function, T cells were centrifuged at 1200×g for 5 minutes. Cell pellets were resuspended in XF assay medium (non-buffered RPMI 1640) containing 5.5 mM glucose, 2 mM L-glutamine, 1 mM sodium pyruvate and seeded at $1\times10^6$ cell per well. The microplate was centrifuged at 1000×g for 5 minutes and incubated in standard culture conditions for 60 minutes. During instrument calibration (30 minutes), the cells were switched to a $CO_2$-free (37° C.) incubator. XF24 and XF96 assay cartridges were calibrated in accordance with the manufacturer's instructions. Cellular oxygen consumption rates (OCRs) were measured under basal conditions and following treatment with 5 mM oligomycin, 5 mM fluoro-carbonyl cyanide phenlhdrazone (FCCP), and 40 nM rotenone, with 1 mM antimycin A (XF Cell Mito Stress kit, Seahorse Bioscience).

Gene Expression Analysis by RT-PCR

Quantitative reverse-transcription polymerase chain reaction (qRT-PCR) was used to quantify expression levels of certain candidate genes. Total RNA from cells was used as a template to synthesize cDNA with a High Capacity RNA-to-cDNA Kit (Applied Biosystems). qRT-PCR was performed in triplicates with Taqman Universal Master Mix on a ViiA 7 Real Time PCR System as per the manufacturer's instructions. mRNA levels of each candidate gene as quantified by the PCR system were normalized to a housekeeping gene, GADPH. All probes used are commercially available (Applied Biosystems).

Glucose Uptake Assay

Cells at day 7 after stimulation were starved in PBS at room temperature for 30 min followed by incubation at 37° C. in regular RPMI culture media supplemented with 11 mM glucose, 10% FCS, 100 U/ml penicillin, 100 mg/ml streptomycin sulfate, and 2 mM glutamax. 500 uL aliquots of cell culture was collected at indicated time points and spun down, and the supernatants were analyzed for glucose and lactate concentrations with the Nova BioProfile Analyzer (Nova Biomedical).

Palmitic Acid Uptake Assay

[$^{13}C_{16}$] palmitic acid was purchased from Sigma-Aldrich. All solvents for liquid chromatography mass spectrometry were Optima grade and purchased from Fisher Scientific. For palmitic acid-labeled isotope experiments, cells were cultured overnight in RPMI 1,640 without D-glucose or L-glutamine (Biological Industries) and supplemented with 10% charcoal-stripped FBS (GIBCO), 2 mM L glutamine (Life Technologies), 5.0 mM glucose, and 100 mM [$^{13}C_{16}$] palmitic acid.

Short-Chain Acyl-CoA Extraction

Extractions were performed as described previously (Basu and Blair, Nat. Protoc. 7, 1-12, 2012; Worth et al., J. Biol. Chem. 289, 26895-26903, 2014). In brief, lymphocytes were centrifuged at 1,200 rcf for 5 min. Cell pellets were resuspended in 750 ml of ice-cold 10% trichloroacetic acid and pulse-sonicated with a sonic dismembrator (Fisher Scientific). The samples were centrifuged at 15,000 rcf for 15 min, and the supernatants were purified by solid-phase extraction. In brief, Oasis HLB 1 ml (30 mg) solid-phase extraction columns were conditioned with 1 ml methanol followed by 1 ml of $H_2O$. The supernatants were applied to the column and washed with 1 ml of $H_2O$. The analytes were eluted in methanol containing 25 mM ammonium acetate, dried overnight in $N_2$ gas, and resuspended in 50 ml of 5% 5-sulfosalicylic acid. 10 ml injections were applied in LC/ESI/MS/MS analysis.

LC/MS Analysis of Acyl-CoA Thioesters

Acyl-CoAs were separated with a Phenomenex Luna C18 reverse-phase high performance liquid chromatography column (2.0 3 150 mm, 5 mm pore size) with 5 mM ammonium acetate in water as solvent A, 5 mM ammonium acetate in acetonitrile (ACN)/water (95:5, v/v) as solvent B, and ACN/water/formic acid (80:20:0.1, v/v) as solvent C, as described previously (Basu et al., Anal. Chem. 83, 1363-1369, 2011; Worth et al., J. Biol. Chem. 289, 26895-26903, 2014). A linear gradient was run as follows: 2% solvent B for 1.5 min, increased to 25% over 3.5 min, increased to 100% over 0.5 min, held for 8.5 min, and washed with 100% solvent C for 5 min before equilibration for 5 min. The flow rate was 200 ml/min. Samples were analyzed with an API 4000 triple-quadrupole mass spectrometer (Applied Biosystems) in the positive electrospray ionization (ESI) mode. Samples (10 ml) were injected with a LEAP autosampler (CTC Analytics AG) and maintained at 4° C. Data were analyzed with Analyst Version 1.4.1 software (AB SCIEX). The column effluent was diverted to the mass spectrometer from 8-23 min and to waste for the remainder of the run. The mass spectrometer operating conditions were as follows: ion spray voltage (5.0 kV), nitrogen as curtain gas (15 U), ion source gas 1 (8 U), ion source gas 2 (15 U), and collision-induced dissociation gas (5 U). The ESI probe temperature was 450° C., the declustering potential was 105V, the entrance potential was 10 V, the collision energy was 45 V, and the collision exit potential was 15 V. A loss of 507 Da was monitored for each acyl-CoA.

Microscopy

Cells at different time points were stained with DiI, Mitotracker green and DAPI (Life Technologies) and fixed with 4% PFA before imaging on the Leica TSC SP8 confocal microscope. Captured images were analyzed with Fiji (ImageJ) and fluorescence emission was quantified as mean fluorescence intensity (MFI). For transmission electron microscopy, the cells were prepared by Penn's Electron Microscopy Resource Laboratory and imaged using the Jeol-1010 microscope.

Statistical Analysis

Wherever indicated, all results are expressed as mean±standard error of mean (SEM) or standard deviation (SD). Statistical comparisons were performed either by the student's t test or a two-way ANOVA model with factors being CAR group and time points of sample collection, using Prism (GraphPad software). The Wilcoxon signed-rank test (two-tailed) was performed on the population doublings between the two CAR T cell groups.

Results

BBz CAR T Cells Show Increased Expansion and Survival Ex Vivo

Figure 32C:
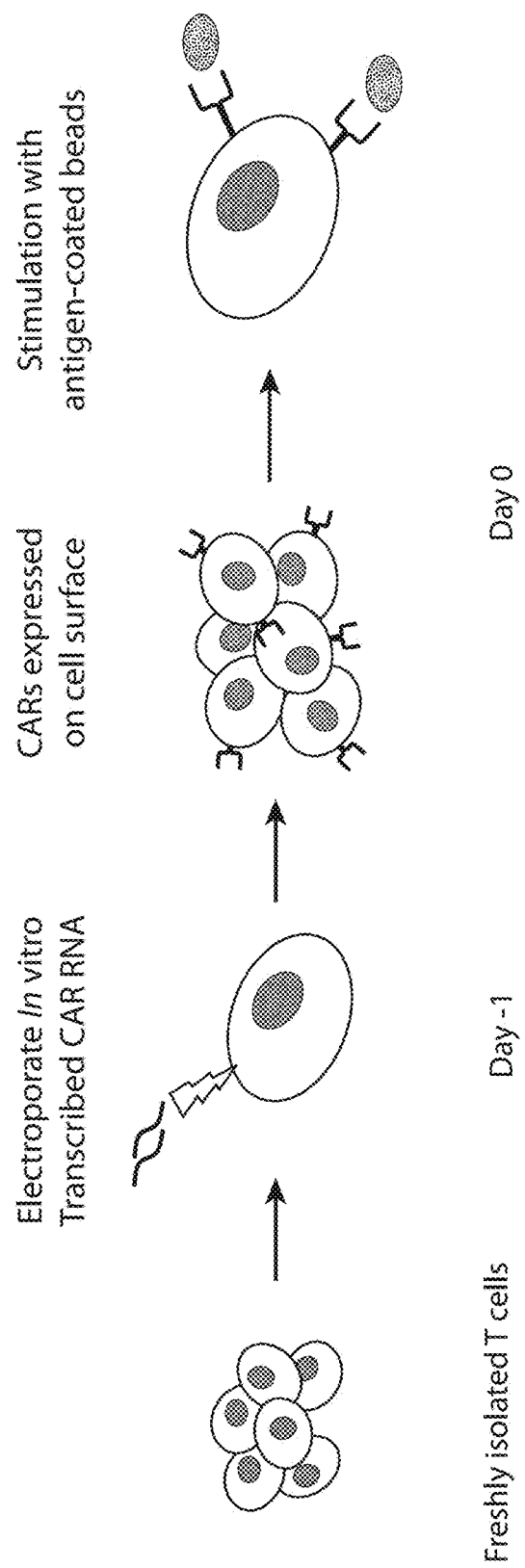
Figure 33A:
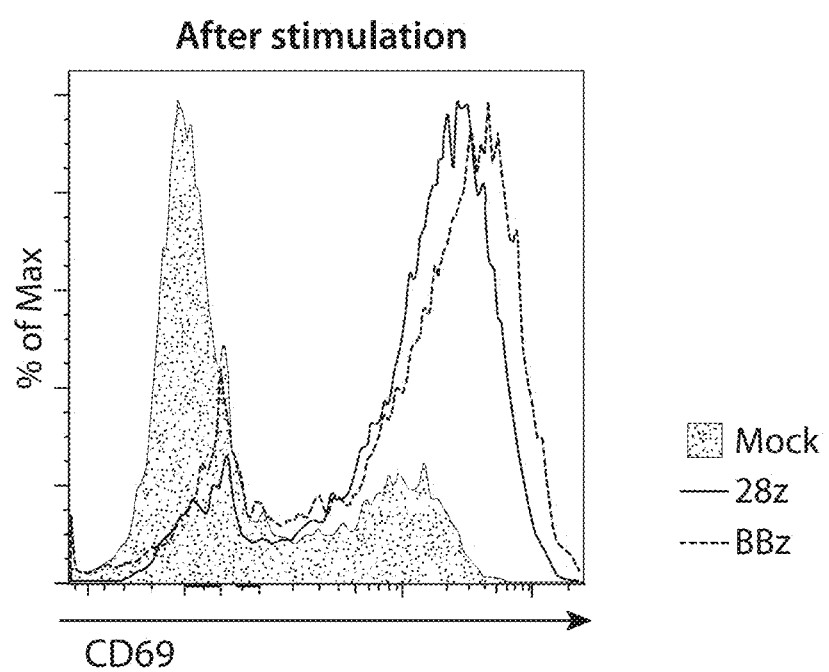
FIGS. 33A-33E show BBz ICD provides a survival and proliferative advantage to CD8 T cells in vitro.
Figure 33B:
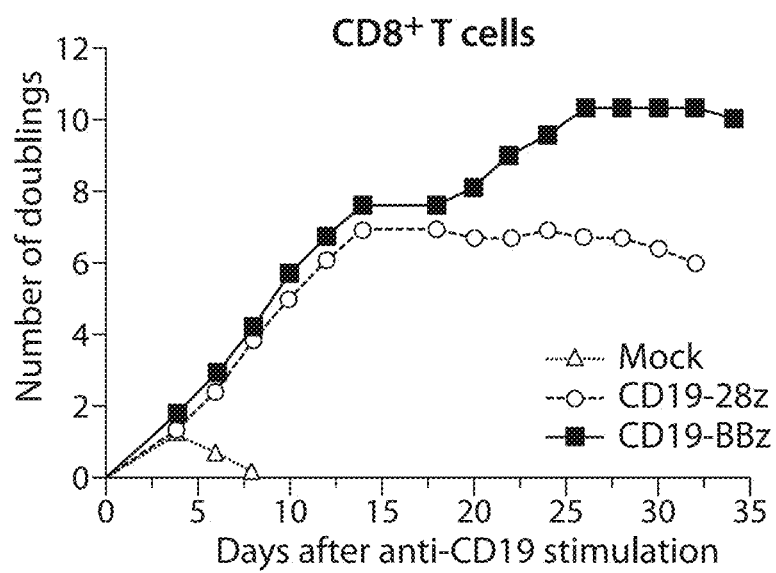
Figure 33B:
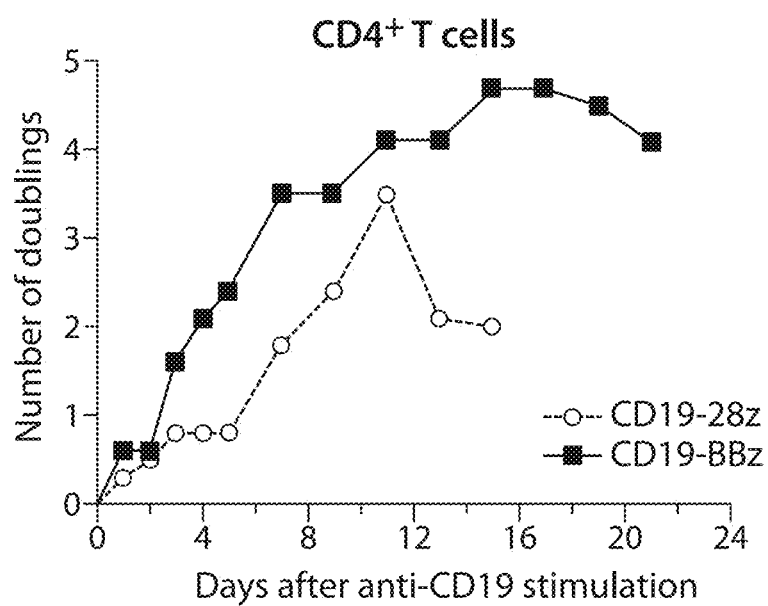
Figure 33C:
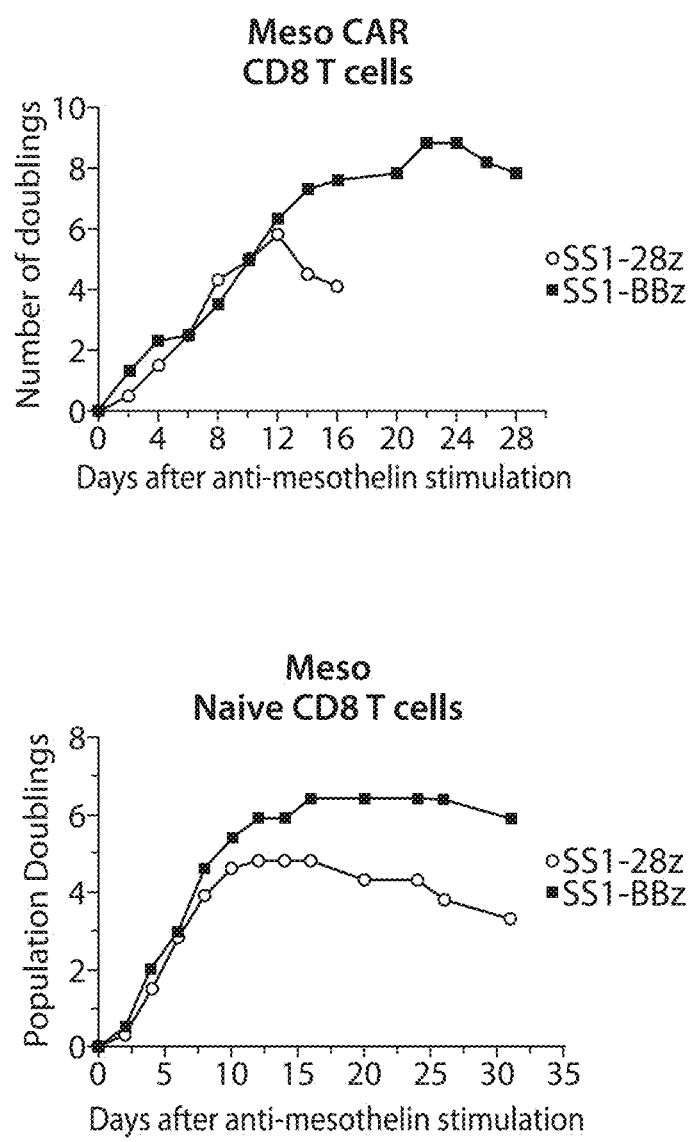

This study initially compared two CD19 CAR designs (FIG. 32A) specific for either CD19 or mesothelin. The CARs were equipped with signaling domains comprised of either CD28 (Kochenderfer et al., J. Immunother. 32, 689-702, 2009) or 4-1BB (Milone et al., Mol. Ther. 17, 1453-1464, 2009). These CARs were chosen because they have been tested extensively in clinical trials (Beatty et al., Cancer Immunol. Res. 2, 112-120, 2014; Kochenderfer et al., Blood 119, 2709-2720, 2012; Lee et al., Lancet 385, 517-528, 2015; Maude et al., N. Engl. J. Med. 371, 1507-1517, 2014; Maus et al., Cancer Immunol. Res. 1, 26-31, 2013; Porter et al., Sci. Transl. Med. 7, 303ra139, 2015). Both CAR constructs were expressed on >90% of CD4+ and CD8+ T cells at comparable mean fluorescence intensities (MFIs) (FIG. 32B). A schematic of the study design is shown in FIG. 32C. The effects of the CD28 and 4-1BB (referred to as 28z and BBz) signaling domains on the differentiation and metabolic fate of T cells. CD4+ T cells were cultured medium supplemented with 30 U/ml of human 1L2. CD8+ T cells were cultured in medium supplemented with either 100 U/ml of human IL2 or 10 ng/ml IL7 and 10 ng/ml IL15, as indicated in the Experimental Procedures. Approximately 24 hours after electroporation, CAR-T cells were stimulated with a bead-bound anti-idiotype-Fc to the FMC-63 scFv, which serves as a surrogate for cognate CD19 antigen. To ensure that the CAR T cells received uniform stimulation, the surface expression of the activation molecule CD69 was analyzed on day 1 after activation. CD69 is an inducible cell-surface glycoprotein that is a sensitive indication of lymphoid activation (Hara et al., J. Exp. Med. 164, 1988-2005, 1986). Cells that received CAR-specific stimulation showed elevated expression of CD69 on day 1 that was similar on 28z and BBz CAR T cells (FIG. 33A). However, the proliferative potential of both CD4 and CD8 T cells bearing the BBz CAR was extended through to at least day 20. In contrast, the proliferative phase of 28z CAR T cells was limited to 14 days (FIGS. 33B and 37, $p<0.01$). CAR surface expression rapidly decreased following stimulation with cognate antigen (FIG. 41). Importantly, cytokine receptor expression was comparable in both CAR groups (FIG. 41), indicating that the proliferative differences between the different CAR T cells are not due to differences in cytokine receptor expression. In one donor, over ten population doublings in the BBz CAR T cell culture, expanding the starting culture of $4 \times 10^6$ cells to a calculated yield of over $5 \times 10^9$ in less than four weeks, were observed (Table 8). The BBz CAR T cells persisted in culture for over 4 weeks in cytokine-supplemented medium following a single stimulation. In contrast, the proliferation and/or survival of the 28z CAR T cells was lower. Although proliferative capacity varied among donors, the trend remained consistent, in that BBz CAR T cells displayed a higher proliferative capacity and persistence in comparison to the 28z CAR T cells (FIG. 40, $p<0.01$). Similar results were obtained with CARs directed against mesothelin (FIG. 33C, FIG. 38, Tables 8 and 10). The remainder of this Example focuses mainly on the effect of CAR design in CD8+ T cells.

TABLE 8

Population doublings and total yield for 3 independent human donor T cells. The BBz T cells continued to persist for longer durations as compared to 28z cells. Cultures were stopped after at least two consecutive decline in cell numbers were observed. BBz CAR T cells also showed higher population doublings in every donor tested. The last column shows the total number of cells obtained by the end of expansion, starting with $4 \times 10^6$ cells in each group.

| Donor # | CAR | Number of days in culture before two consecutive population declines | Total Population Doublings | Maximum cell yield in culture ($\times 10^6$ cells) |
|---|---|---|---|---|
| 1 | 28z | 20 | 4.3 | 78.80 |
|   | BBz | 22 | 5.0 | 128.00 |
| 2 | 28z | 22 | 6.0 | 256.00 |
|   | BBz | 28 | 7.2 | 588.13 |
| 3 | 28z | 24 | 6.9 | 477.71 |
|   | BBz | 30 | 10.3 | 5,042.77 |

BBζ CAR Signaling Promotes Enhanced Central Memory T Cell (TCM) Subset

Figure 33D:
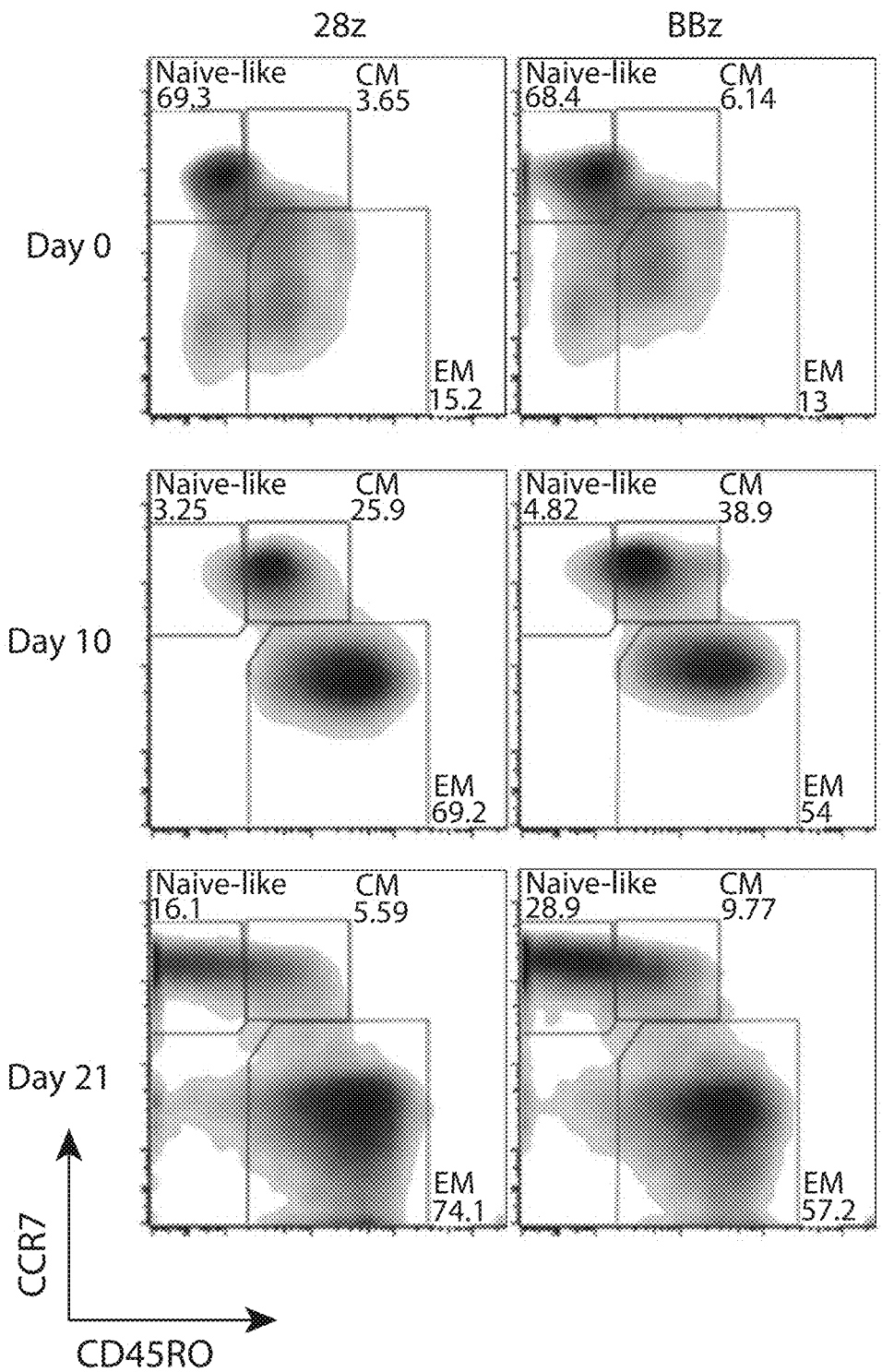
Figure 33E:
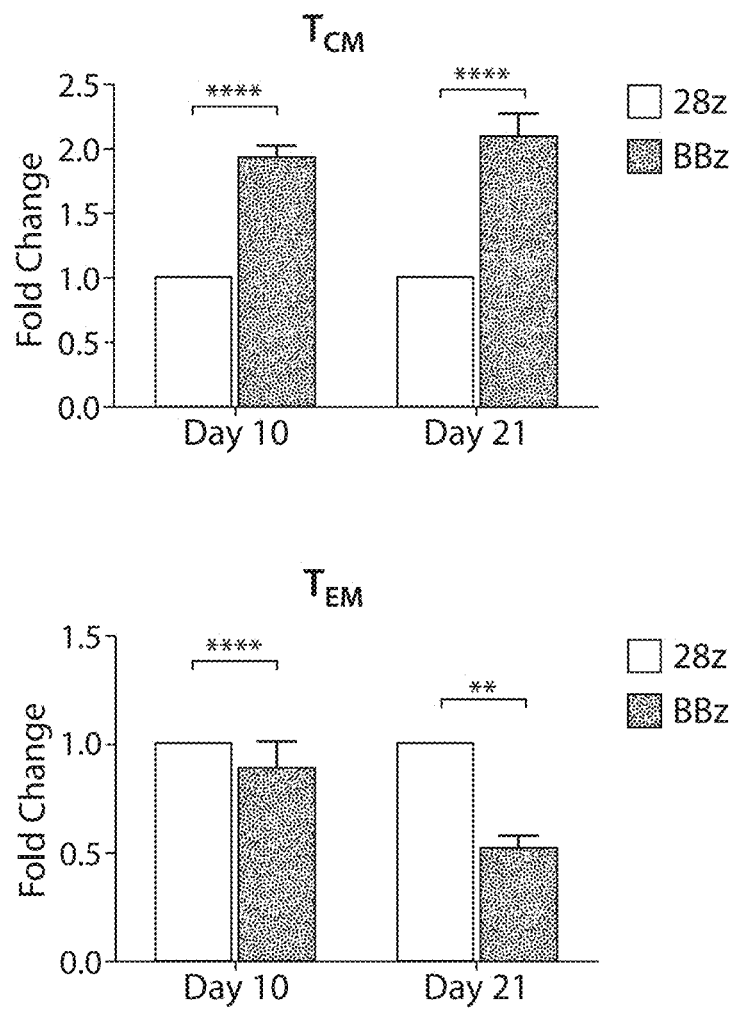

It was hypothesized that the enhanced persistence of BBz T cells was due to a relative preservation of cells with a more extensive proliferative capacity. To test the differentiation status of BBz and 28z CAR-T cells, a standard panel of cell-surface markers associated with T cell differentiation was used. Expression of CD45RO and CCR7, which are associated with Tcm cells was assessed. All cultures contained the same heterogeneous population of T cell subsets at day 0. After stimulation through the CAR, the proportion of CD45RO+CCR7+ cells was progressively enriched (FIG. 33D). Notably, the enrichment of this Tcm cell population was higher in the BBz CAR group in comparison to the 28z group ($p<0.01$), and persisted through the end of culture (FIG. 33E). In contrast, the 28z CAR cultures consistently yielded a higher proportion of effector-memory phenotype (Tem), identified as CD45RO+CCR7- cells. The partitioning/differentiation of cells into memory phenotypic pools could potentially be attributed with the difference in longevity of the cells stimulated with a BBz CAR versus a 28z CAR.

TABLE 9

Absolute cell counts showing proportion of $T_E$ and $T_M$ cells in culture for 3 donors. 28z CAR T cells show a higher percentage and a higher number of cells that are decorated with markers characteristic of $T_E$ cells. On the other hand BBz CAR T cells had higher numbers with the $T_M$ phenotype.

| | | Absolute counts (# of cells per 26,500 beads counted) | | | | | |
|---|---|---|---|---|---|---|---|
| | | Day 0 | | Day 20 | | Day 27 | |
| Donor # | CAR | CD62L− CCR7− | CD62L+ CCR7+ | CD62L− CCR7− | CD62L+ CCR7+ | CD62L− CCR7− | CD62L+ CCR7+ |
| 1 | 28z | 13827 | 12318 | 52168 | 32908 | 83217 | 28801 |
|   | BBz | 9473 | 10237 | 41498 | 39928 | 72570 | 31474 |

TABLE 9-continued

Absolute cell counts showing proportion of $T_E$ and $T_M$ cells in culture for 3 donors. 28z CAR T cells show a higher percentage and a higher number of cells that are decorated with markers characteristic of $T_E$ cells. On the other hand BBz CAR T cells had higher numbers with the $T_M$ phenotype.

| | | Absolute counts (# of cells per 26,500 beads counted) | | | | | |
|---|---|---|---|---|---|---|---|
| | | Day 0 | | Day 20 | | Day 27 | |
| Donor # | CAR | CD62L− CCR7− | CD62L+ CCR7+ | CD62L− CCR7− | CD62L+ CCR7+ | CD62L− CCR7− | CD62L+ CCR7+ |
| 2 | 28z | 46596 | 32002 | 124638 | 19398 | 81519 | 9725 |
| | BBz | 40388 | 29813 | 86700 | 31259 | 48066 | 14058 |
| 3 | 28z | 61969 | 43819 | 28461 | 43849 | 53213 | 23418 |
| | BBz | 62743 | 46127 | 18256 | 79659 | 4136 | 24459 |

TABLE 10

Population doublings and total yield for 3 independent human donor T cells stimulated through meso CAR. The last column shows the total number of cells obtained by the end of expansion, starting with $4 \times 10^6$ cells in each group. Data is from 3 representative donors (out of at least 6 independent donor T cells tested).

| Donor # | SS1 CAR | Number of days in culture before two consecutive declines | Total Population Doublings | Maximum number of cells reached in culture ($\times 10^6$ cells) |
|---|---|---|---|---|
| 1 | 28z | 12 | 5.8 | 222.86 |
| | BBz | 24 | 8.8 | 1,782.89 |
| 2 | 28z | 16 | 6.9 | 477.71 |
| | BBz | 24 | 8.4 | 1,351.18 |
| 3 | 28z | 14 | 6.0 | 256.00 |
| | BBz | 22 | 8.4 | 1,351.18 |

CAR Signaling Domains Reprogram T Cell Metabolism (BBζ CAR T Cells Demonstrate Distinct Oxidative Features)

Upon stimulation, CD8+ T cells undergo an ordered process involving proliferation and differentiation into effector and memory cells. Activation is associated with a biosynthetic and bioenergetics flux required to support T cell proliferation and function (Pearce and Pearce, Immunity 38, 633-643, 2013; Wang and Green, Nat. Immunol. 13, 907-915, 2012). For example, naïve and memory T cells rely primarily on the mitochondrial oxidation of free fatty acids for development and persistence (Pearce et al., Nature 460, 103-107, 2009; van der Windt et al., Immunity 36, 68-78, 2012). In contrast, activated effector T cells shift to glycolysis (or concurrently upregulate oxidative phosphorylation and aerobic glycolysis) to fulfill the metabolic demands of proliferation (van der Windt et al., Immunity 36, 68-78, 2012). Among other factors including signaling events, cell death and immunological functions, that regulate T cell differentiation and survival, this Example investigates the interconnection of cellular metabolism to the observations seen above.

Figure 34A:
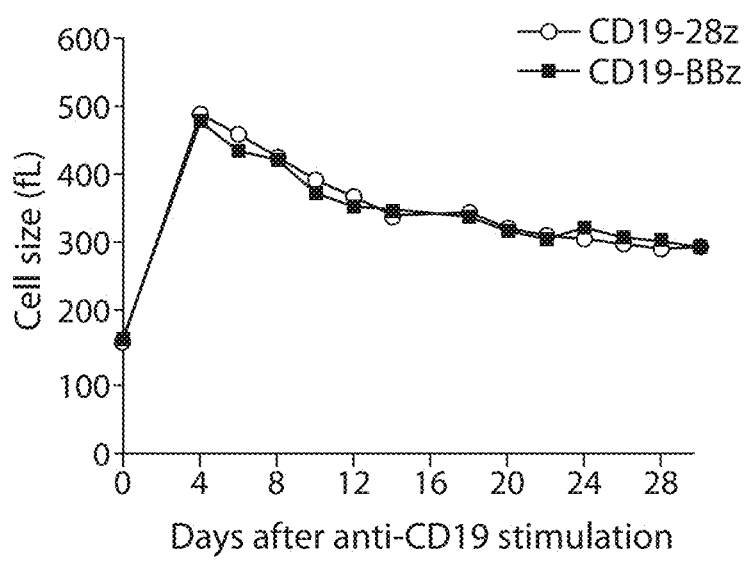
FIGS. 34A-34M show the effects of CAR signaling domain on cellular metabolism and preferential reliance on glycolysis or fatty acid oxidation by CAR T cells.
Figure 34B:
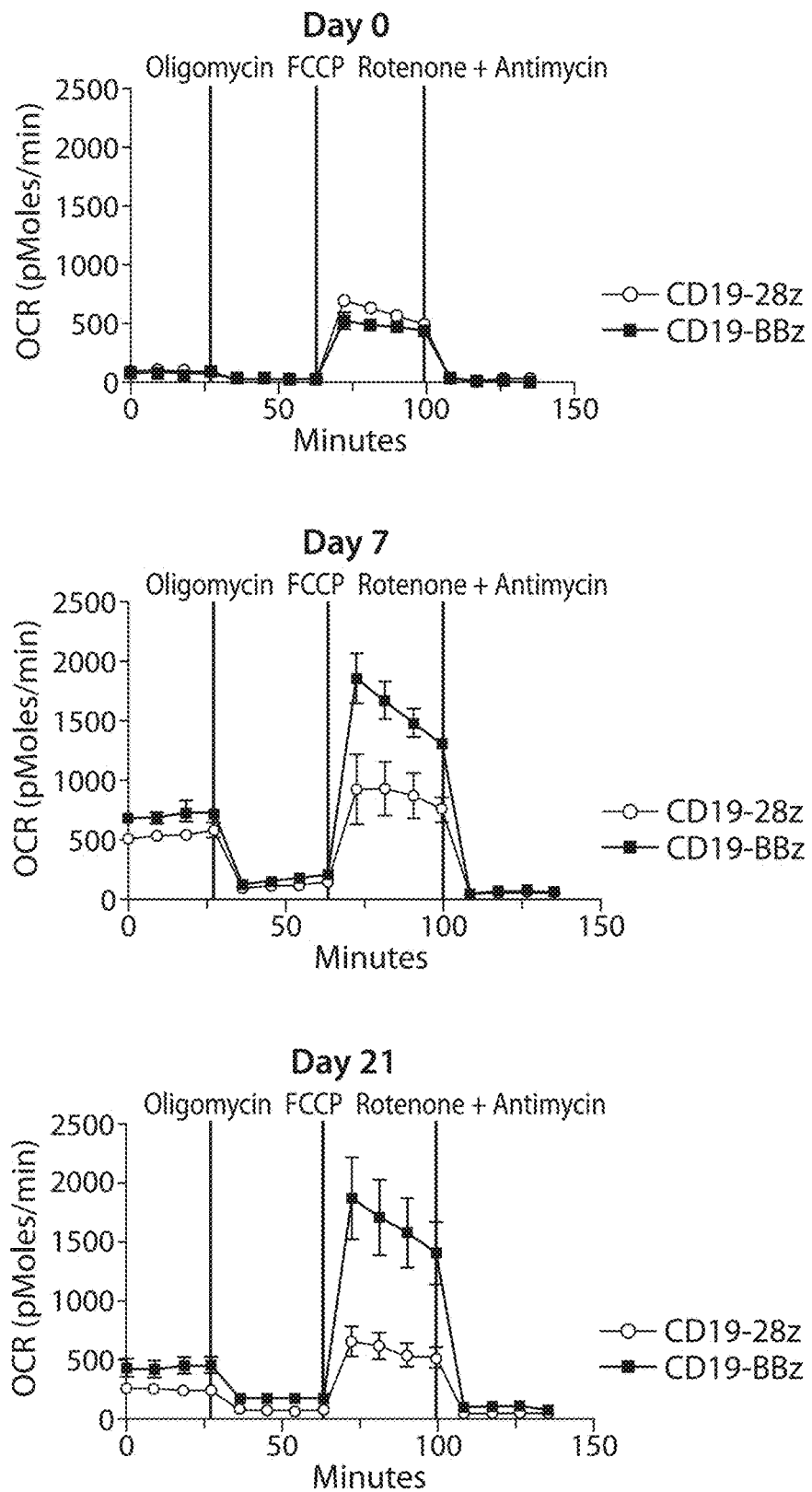
Figure 34C:
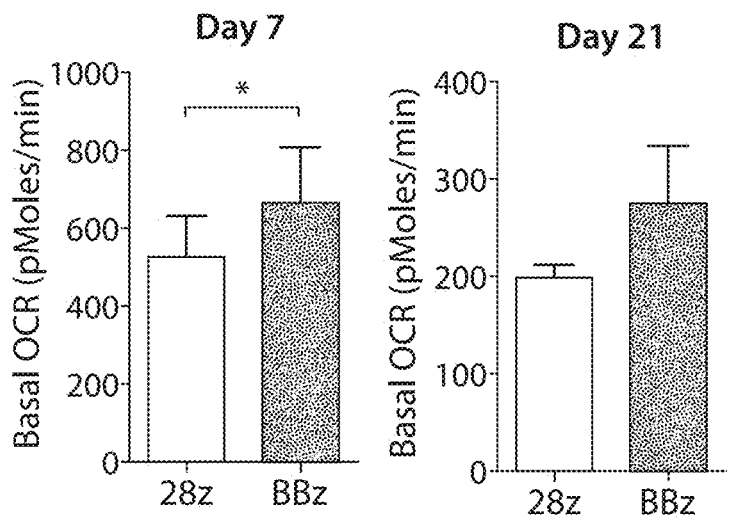
Figure 34D:
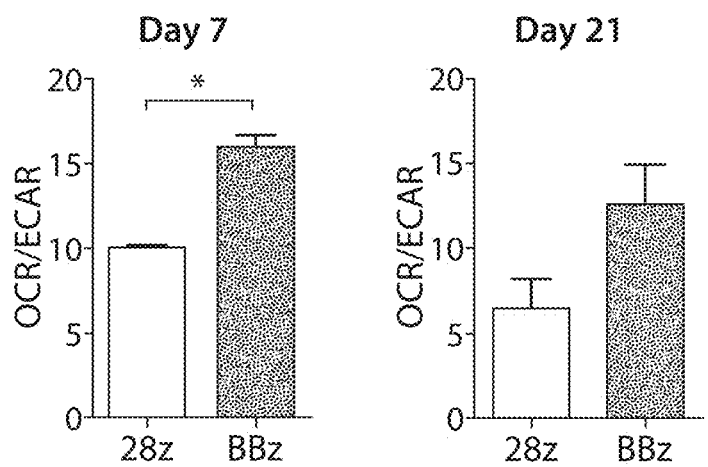
Figure 34E:
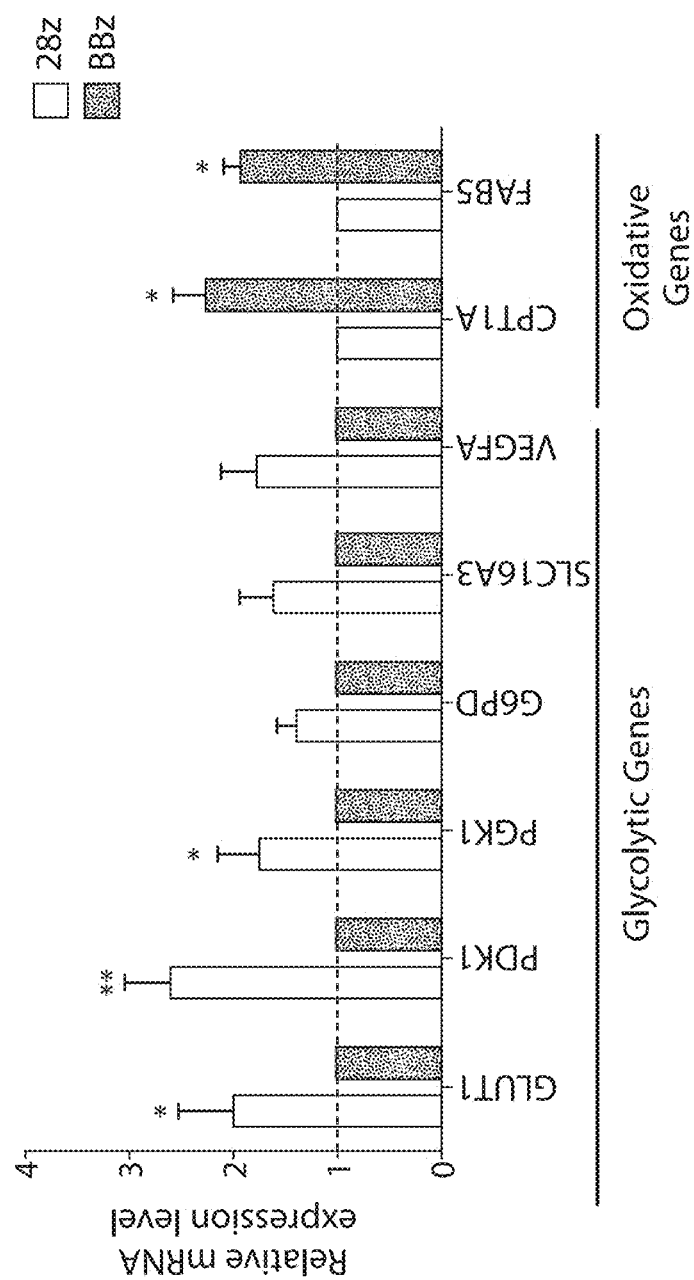
Figure 34F:
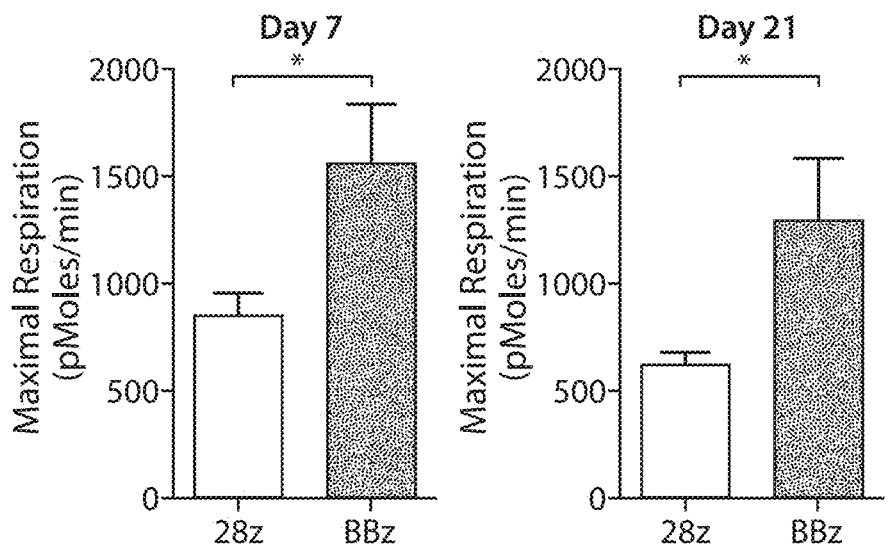
Figure 34G:
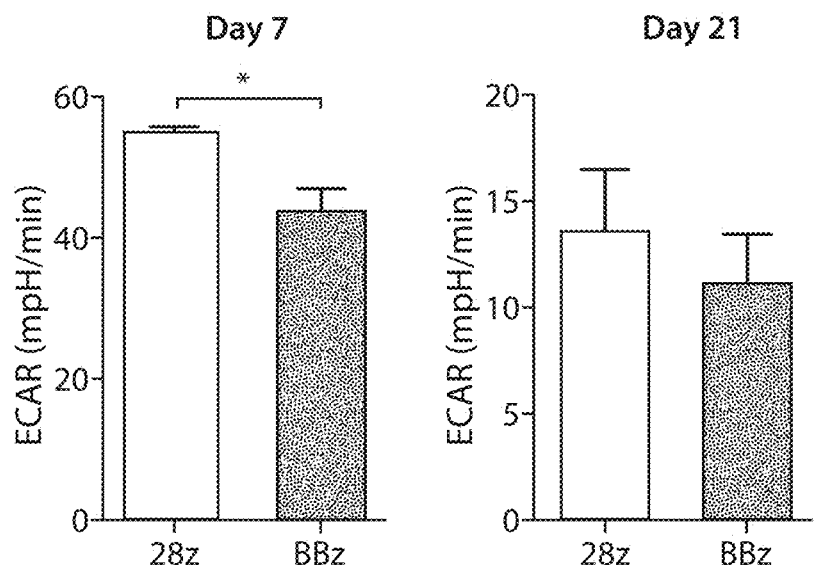

Based on the distinct growth rates and differentiation of 28z and BBz CAR T cells, we sought to explore the interconnection of cellular metabolism and CAR signaling. First, the metabolic profiles of T cells expressing the two CARs at different time points after stimulation were examined. Cell volume, a surrogate for cell mass, was found to be comparable after cognate antigen stimulation (FIG. 34A). The oxygen consumption rate (OCR) of 28z and BBz CAR T cells before and 7 and 21 days after antigenic stimulation during log-phase proliferation was measured. Basal OCR was measured, followed by serial additions of oligomycin (an inhibitor of ATP synthesis), carbonyl cyanide-ptrifluoromethoxyphenylhydrazone (FCCP; an uncoupling ionophore), and rotenone with antimycin A (blocking agents for complex I and III of the electron transport chain, respectively) (van der Windt et al., Immunity 36, 68-78, 2012). The OCR profiles were similar before antigen stimulation on day 0 (FIG. 34B). After antigen stimulation, there was a ~10-fold increase in basal OCR in both groups of T cells on days 7 and 21 (FIG. 34C). However, there was a robust increase in maximal respiratory capacity that was specific to the BBz CAR T cells, following decoupling of the mitochondrial membrane using FCCP on both days 7 and 21 (FIG. 34F). In contrast the maximal respiratory capacity of the 28z CAR T cells on days 7 and 21 was similar to what it was on day 0. To confirm that these differences in OCR were due to the signaling domains of the receptor, similar experiments were performed with mesothelin-specific CAR T cells. The mesothelin-BBz CAR T cells exhibited an elevated basal and maximal respiratory capacity compared to the 28z CAR T cells on days 7 and 21 after stimulation with mesothelin (FIG. 39). The extracellular acidification rate (ECAR) was also measured as a measurable surrogate for lactic acid production during glycolysis. Glycolysis involves a series of enzyme-catalyzed reactions culminating in the production of lactic acid. At physiologic pH, lactic acid dissociates into lactate and H+ which are exported extracellularly. ECAR levels were elevated in 28z cells in comparison to BBz CAR T cells on days 7 and 21 (FIGS. 34D and 34G).

Figure 34H:
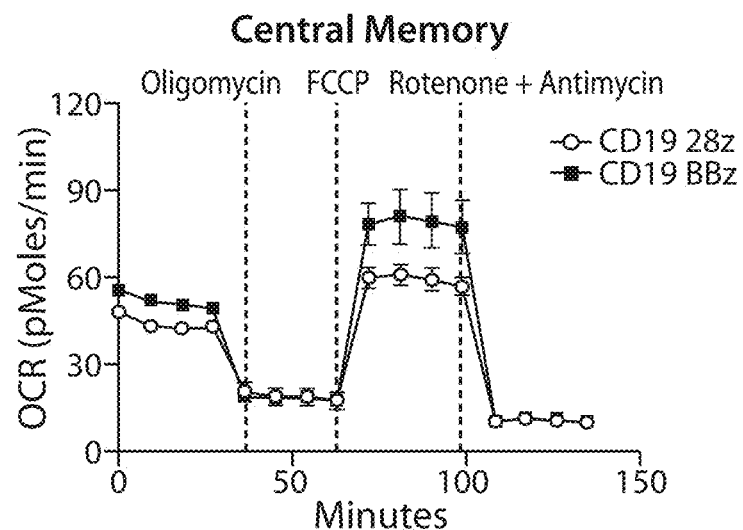
Figure 34I:
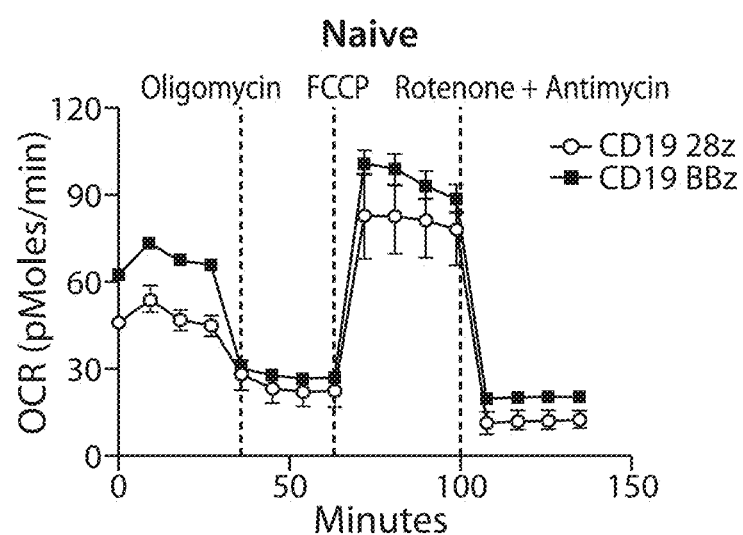
Figure 34J:
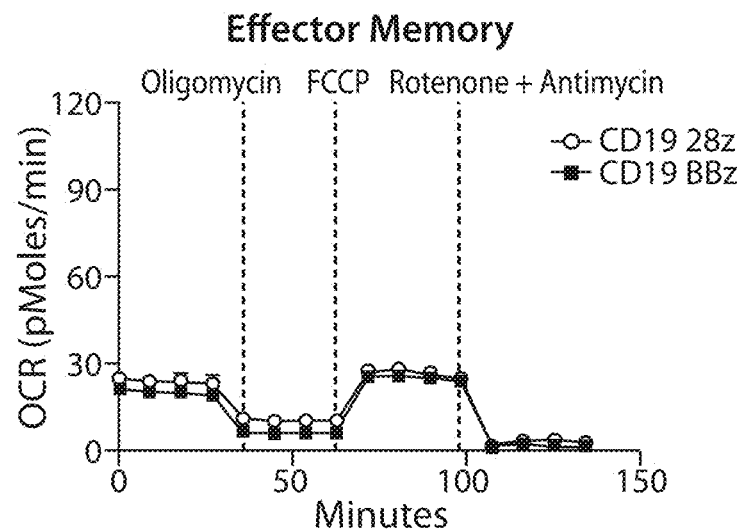
Figure 34K:
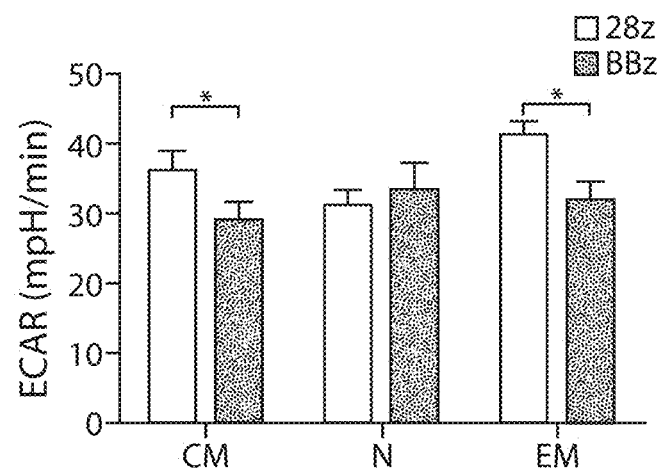

Several reports have shown that natural central memory differentiated T cells display elevated basal OCR and SRC in comparison to effector memory and terminally differentiated effector cells. These oxidative features suggest that an increased reliance on fatty acid oxidation (FAO) may be necessary for central memory differentiation and survival (Pearce et al., Nature 460, 103-107, 2009; van der Windt et al., Immunity 36, 68-78, 2012). Because a differential enrichment of memory phenotypes was seen in the two CAR T cell groups in culture, the analysis was extended to uncover how individual memory subsets contribute to the metabolic properties of CART cells. Again, using CCR7 and CD45RO as phenotypic markers, the populations were sorted into CCR7+CD45RO−, CCR7+CD45RO+, and CCR7−CD45RO+ to define naive-like, Tcm cell, and Tem cell subpopulations, respectively. Metabolic flux revealed higher basal OCR and maximum respiratory capacity of the BBz in the Tcm and Tn memory sub-types as compared to 28z CART cells (FIGS. 34H and 34I). As observed in past reports concerning effector cells, the basal OCR as well as the maximum respiratory levels remained low for the Tem cell subpopulations for both CAR groups (FIG. 34J). On the other hand, the ECAR levels remained higher for Tcm and Tem cell subpopulations of cells obtained from the 28z CAR T cell culture (FIG. 34K). In aggregate, these studies show that BBz CAR T cells are metabolically distinct from 28z CAR T cells with the former displaying greater capacity for oxidative metabolism that might contribute to the enhanced central memory differentiation and persistence of BBz CAR T cells.

28z and BBz CAR T Cells have Distinct Glycolytic and Fatty Acid Metabolism

Figure 34L:
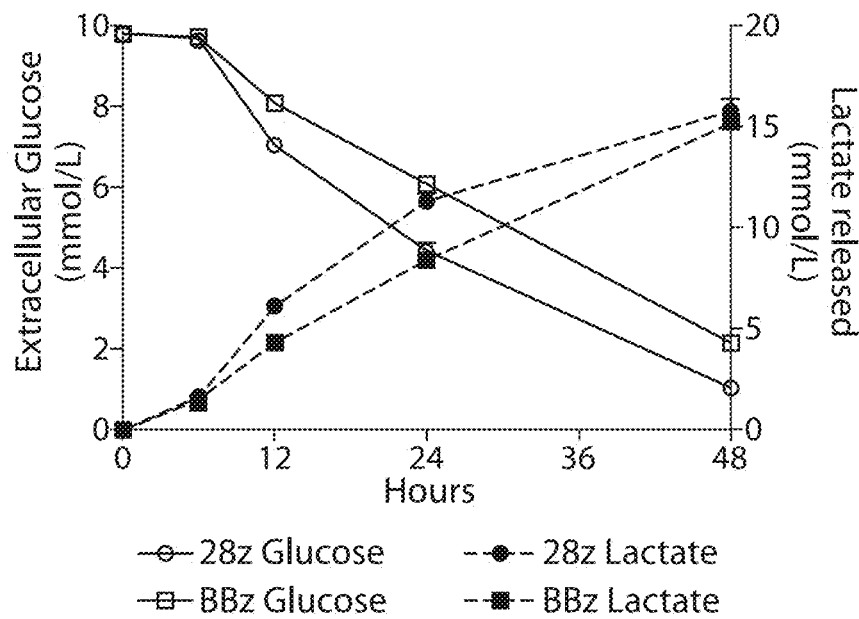

To investigate whether the differences in the basal OCR in CAR T cells altered the fuel sources by which these cells satisfy their bioenergetic appetite, glucose uptake and fatty acid utilization rates were measured in CAR T cells. At day 7 after stimulation, the cells were replated in fresh media. At different points (as indicated in FIG. 34L), the amount of residual glucose in the media and the lactate produced were measured. 28z CAR T cells consumed glucose at a relatively quicker rate along with production of lactic acid. This is consistent with the greater ECAR we observed in 28z CAR T cells (FIGS. 34G and 34K).

Figure 34M:
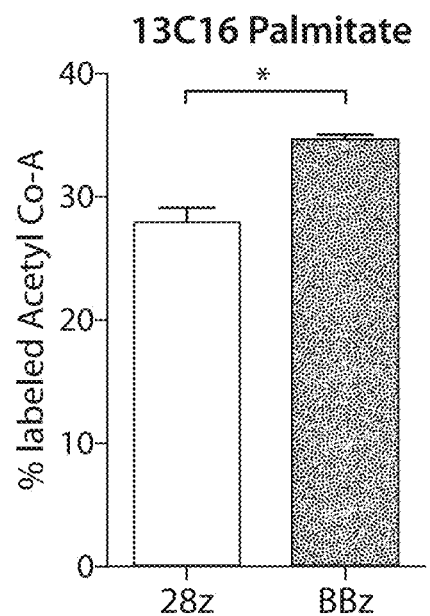

The increased OCR in BBz CAR T cells prompted us to examine the fatty acid consumption rate in these cells. Using a heavy-carbon-labeled long-chain fatty acid (palmitic acid), its uptake rate was analyzed by measuring the levels of heavy-carbon-labeled acetyl-CoA. The catabolic process of b oxidation breaks down fatty acid molecules into acetyl-CoA in the mitochondria to feed the citric-acid cycle. It was found that BBz showed a higher percentage of labeled acetyl-CoA pool as compared to 28z CAR T cells (FIG. 34M). This data suggest that BBz CAR T cells, similar to CD8+ Tcm cells, extensively rely on catabolic pathways such as FAO to fuel their bioenergetic demands.

To gain insight into the mechanism leading to the metabolic differences conferred by distinct CAR signaling domains expression of candidate genes that are implicated in glycolytic and lipid metabolism were measured. Two main enzymes implicated in glucose metabolism, Glut1 and PDK1, were initially focused on. The cell-surface expression of Glut1, the transporter involved in glucose uptake, is induced following CD28 activation (Frauwirth et al., Immunity 16, 769-777, 2002). In certain contexts, including hypoxia, PDK1 inhibits the decarboxylation of pyruvate and entry of glucose derivatives into the tricarboxylic acid (TCA) cycle (Duvel et al., Mol. Cell 39, 171-183, 2010). Both Glut1 and PDK1 are induced to significantly higher levels in 28z cells relative to BBz cells at day 7 (FIG. 34E). Increased expression levels of Glut1 and PDK1, coupled with the earlier finding of increased ECAR, is consistent with enhanced glycolysis in 28z CAR T cells in comparison to their BBz counterparts.

Two important enzymes involved in the breakdown of glucose during the ATP-generating step of the glycolytic pathway are phosphoglycerate kinase (PGK) and glucose-6-phosphate dehydrogenase (G6PD). PGK transfers a phosphate group to ADP in order to facilitate ATP generation, whereas G6PD, an NADP+-dependent enzyme, catalyzes the oxidative phase of the pentose phosphate pathway (PPP). Given that these enzymes have an important role in glycolysis, their expression levels in CAR T cells were investigated on Day 7. Their levels were elevated in 28z CAR T cells. Finally, the levels of solute carrier family 16 (SLC16A3), an exporter of the glycolysis byproducts, lactic acid and pyruvate, were also examined. 28z CAR T cells showed higher levels of SLC16A3 mRNA in comparison to BBz T cells, consistent with the hypothesis that 28z CAR T cells use increased glycolysis as a means to meet their metabolic demands. Increased expression of VEGFA was also detected in 28z CAR T cells, which is an established target of the hypoxiainducible factors (HIF). Several genes involved in glycolysis are targets of HIF1a (Finlay et al., J. Exp. Med. 209, 2441-2453, 2012), including Glut1 and PFK. Others have shown that HIF1A-/- T cells display impaired autoreactivity (Dang et al., Cell 146, 772-784, 2011). The findings shown in this Example add to the growing body of evidence implicating costimulation through CD28 and glycolytic reprogramming in effector differentiation. Next, genes associated with mitochondrial FAO were investigated. Increasing evidence has demonstrated a role for carnitine palmitoyl transferase (CPT1A) in regulating oxidative metabolism in CD8+ cells (van der Windt et al., Immunity 36, 68-78, 2012). CPT1A is a metabolic enzyme that controls a rate-limiting step in mitochondrial FAO and promotes mitochondrial biogenesis. Significantly higher levels of CPT1A mRNA were observed in BBz CAR T cells in comparison to 28z CAR T cells. Additionally, mRNA levels of fatty acid binding protein (FABPS), which plays a critical role in long-chain fatty acid uptake, transport and metabolism were significantly upregulated in BBz CAR T cells in comparison to 28z (FIG. 34E). These findings suggest that 28z CAR T cells rely more on a glycolytic-based metabolism whereas BBz programs T cells to use fatty acids as the predominant energy source, which are characteristics of natural effector and memory T cells, respectively.

BBζ CAR T Cells have Increased Spare Respiratory Capacity

Mitochondrial spare respiratory capacity (SRC) is a measure of how effectively protons can be shuttled into the mitochondrial intermembrane space upon cellular or mitochondrial stress (Mookerjee et al., Mech. Ageing Dev. 131, 463-472, 2010; Nicholls, Biochem. Soc. Trans. 37, 1385-1388, 2009). SRC enhances survival and function of memory T cells by providing a contingency source of energy for cells exposed to metabolic stress including nutrient depletion, oxygen deprivation or under conditions of increased cellular activity. Increased SRC likely supports T cell function in a hostile tumor environment (Ferrick et al., Drug Discov. Today 13, 268-274, 2008; Nicholls, Biochem. Soc. Trans. 37, 1385-1388, 2009; Yadava and Nicholls, J. Neurosci. 27, 7310-7317, 2007). Memory CD8 T cells, unlike effectors, maintain a substantial SRC (van der Windt et al., Immunity 36, 68-78, 2012). When comparing the SRC of the two CAR groups, it was observed that BBz CAR T cells maintained higher levels of SRC in comparison to 28z CAR T cells at Day 7 and Day 21 post stimulation (FIG. 35A). This is consistent with the metabolic characteristics of long-lived CD8+ memory cells, lending additional support to the hypothesis that BBz signals support a metabolic reprogramming that contributes to long-lived memory-like T cells.

Given the role of mitochondrial density in oxidative metabolism (van der Windt et al., Immunity 36, 68-78, 2012), the possibility that the increased SRC in BBz CAR T cells was associated with an increase in mitochondrial mass was explored. Using electron microscopy, similar mitochondrial density between 28z and BBz CAR-T cells was measured at day 7 (FIGS. 35B and 35C). However, there was a substantial increase in mitochondrial mass in BBz CAR T cells at days 14 (FIG. 35B) and 21 (FIG. 42) after antigen stimulation. Despite similar cell volumes (FIG. 34A), a significantly (p<0.001) increased density of mitochondria in BBz CAR-T cells. To confirm that BBz CAR T cells have enhanced mitochondrial content, we also measured mitochondrial density using confocal microscopy (FIG. 36A). BBz CAR T cells showed an increased ratio of mitochondrial mass to total cell mass on days 14 and 21 (FIG. 36B).

BBz CAR T Show Enhanced Mitochondrial Biogenesis

It was contemplated that specific signals from the 4-1BB signaling domain in the CAR structure supported mitochondrial biogenesis, thus endowing these cells with greater mitochondrial mass. However, in addition to quantitative differences in mitochondrial content, it was examined whether qualitative differences in mitochondria might contribute to the differences in metabolic profiles between these CAR cells. Level of certain mitochondrial genes encoded by the nuclear the mitochondrial genome, namely mitochondrial transcription factor A (TFAM) and MTCO-1, respectively, was examined. Notably, BBz cells had significantly enhanced mRNA expression of mitochondrial TFAM and mitochondrially encoded cytochrome c oxidase 1, the main subunit of the cytochrome c oxidase complex (FIG. 36C).

To explore the role of 28z and BBz costimulatory domains on the mitochondrial function in the context of CAR T cells, we measured gene expression of two transcription factors of mitochondrial genes, namely nuclear respiratory factor 1 (NRF1) and GA-binding protein (also known as NRF2). Whereas NRF1 regulates the expression of TFAM and coordinates mtDNA replication and expression, NRF2 has a role in the transcription of the OXPHOS components, mitochondrial import, and TFAM. Consistent with its enhanced oxidative features as seen by metabolic flux analyses and mitochondrial density, we found that BBz CAR T cells had significantly higher expression of NRF1 and NRF2 in comparison to the 28z CAR T cell group (FIG. 36D).

Taken together, these findings suggest increased mitochondrial content in BBz CAR T cells in comparison to 28z CAR T cells, which strongly correlates with the increased SRC observed in these cells. These findings are consistent with a model in which BBz signaling reprograms transcriptional networks supporting mitochondrial biogenesis and oxidative metabolism. Given the role of metabolic adaptation in allowing for T cell memory and effector functions, the aforementioned oxidative features in BBz CAR T cells most likely support central memory differentiation and T cell persistence.

Discussion

These studies uncover significant differences in the differentiation and metabolic profiles of CAR T cells using CD28 or 4-1BB signaling domains. The predominant metabolic program in 28z CAR T cells is aerobic glycolysis, and, in BBz CAR T cells, it is oxidative breakdown of fatty acids. The studies provide evidence for plasticity in T cell metabolic reprogramming and, further, that the choice of CAR signaling domain can impact the subsequent fate of the T cells. The enhanced proliferation and persistence of BBz over 28z CAR T cells observed in the studies mirrors the outcomes of CAR persistence observed in clinical studies (Brentjens et al., Sci. Transl. Med. 5, 177ra38, 2013; Brentjens et al., Blood 118, 4817-4828, 2011; Lee et al., Lancet 385, 517-528, 2015; Porter et al., Sci. Transl. Med. 7, 303ra139, 2015). The studies suggest that one mechanism for the differential persistence may be the metabolic reprogramming of the CART cells to enhance either oxidative phosphorylation that is characteristic of memory cells or aerobic glycolysis that is characteristic of effector cells (MacIver et al., Annu. Rev. Immunol. 31, 259-283, 2013; van der Windt et al., Immunity 36, 68-78, 2012).

Previous studies have shown that CD28 signaling initiates a cascade leading to enhanced surface expression of Glut1 and increased reliance on aerobic glycolysis (Frauwirth et al., Immunity 16, 769-777, 2002). In contrast, a TNFR pathway is required for the initiation of mitochondrial FAO and T cell memory development (Pearce et al., Nature 460, 103-107, 2009). Although IL2 promotes effector differentiation and glycolysis in CD8+ T cells (Finlay et al., J. Exp. Med. 209, 2441-2453, 2012; Liao et al., Immunity 38, 13-25, 2013; Pipkin et al., Immunity 32, 79-90, 2010), IL7 and IL15 have been implicated in the maintenance of memory T cells and increased mitochondrial biogenesis (Ku et al., 2000; Schluns and Lefranc, ois, 2003; van der Windt et al., Immunity 36, 68-78, 2012). Given that human CD8+ T survival is impaired in the absence of exogenous cytokines, IL7 and IL15 are necessarily present in the culture system. Although these extrinsic factors may play a significant role in stabilizing the metabolic profiles of T cells, it was hypothesized that the system described in this example is largely governed by cell-intrinsic factors influenced by the two unique intracellular CAR signaling domains. This is further corroborated by the lack of differences in the cell-surface expression of these cytokine receptors, suggesting that the relative distinction in metabolic reprogramming between the two CARs cannot be solely mediated by the supplemented cytokines. Thus, the studies suggest that the ectopic expression of CD28 or 4-1BB signaling domains in CARs leads to a phenocopy of the natural T cell activation process. By extension, the studies suggest that the incorporation of various signaling modules may biosynthetically reprogram T cells to desired effector or regulatory functions. For example, it was found that the incorporation of the ICOS signaling domain in CARs promotes a Th17 cell differentiation program (Guedan et al., Blood 124, 1070-1080, 2014).

One clinical application of the findings is that short-lived or long-lived CAR T cells can be created "at will." This could extend the range of targets, depending on certain surface molecules where long-term CAR effects may not be tolerable due to potential off-tumor toxicity. In this case, a CD28 signaling domain would be expected to be superior. Another implication from the studies is that a mixture of CAR T cells expressing 4-1BB and CD28 domains may be superior to either CAR as a single population. This was contemplated because the combination of CAR T cells would be expected to more completely mimic a natural immune response comprised of an early dominance of T effector cells, achieved with CD28 CARs having enhanced aerobic glycolysis in the cytoplasm, and T memory cells, achieved with 4-1BB CARs having enhanced mitochondrial oxidative phosphorylation.

Apart from cell intrinsic factors, there has been substantial interest in understanding the effects of nutrient consumption on T cell survival in the tumor microenvironment. T cells have substantial bioenergetics and biosynthetic challenges to survive and conduct effector functions. The results that BBz CAR T cells have an increased capacity to generate mitochondrial mass. This increase in mitochondrial mass provides a survival advantage (van der Windt et al., 2013). A higher SRC was consistently seen in BBz CAR T cells, and this mitochondrial respiratory capacity has been shown to be an important characteristic of natural CD8+ T cell memory development (van der Windt et al., Immunity 36, 68-78, 2012). The increased basal oxygen consumption of BBz cells also suggests a preferential reliance on oxidative phosphorylation as the predominant energy generating mechanism to account for the metabolic demands required for enhanced CAR T cell proliferation Furthermore, the data suggest that metabolism is an important mediator of CAR T cell survival and is influenced by the signaling induced by the costimulatory domain included in the CAR. In summary, these results reveal a new role for CAR T cell engineering to control T cell metabolism as a key determinant of T cell effector and memory responses. Using synthetic biology, it is possible to shape the immune response to a desired balance of long-lived memory cells and short-lived effector cells. By extension, the studies should influence the design of engineered T effector or engineered T regulatory cells that resist exhaustion or have enhanced survival in hostile tumor and inflammatory microenvironments.

Example 7: Activation and Expansion of T Cells Via Transiently Expressed CARs

In this protocol, complete activation and robust expansion of T cells is achieved by stimulation of a transiently expressed Chimeric Antigen Receptor (CAR) on the cell surface. The stimulation is carried out with an antigenic recombinant protein, instead of using antibodies. The antigen specificity of CARs is conferred by antibody fragments, also known as single-chain variable fragments (scFv). This scFv is held up on the surface of the T cell by a hinge, and is linked to signaling domains through a trans-membrane domain. The signaling domain could either be just a CD3z signaling tail ($1^{st}$ generation CAR) or intra-cellular segments of CD28, 4-1BB, and/or ICOSz in addition to CD3z. This obviates the need for a TCR to stimulate the cell. The recombinant protein can be manufactured in-house and coated on culture plates or cross-linked to microbeads to stimulate lymphocytes. Also, since the CAR is transiently expressed on the cell surface, and is then internalized post a single antigen-engagement, the cells do not receive repeated stimulations. This protocol can be customized to any CAR model. By adjusting the CAR-surface density as well the affinity of the scFv domain, the strength of the stimulations can be fine-tuned to desired levels. Cutting around the caveats of the conventional TCR-stimulated expansion protocol, this new protocol shows comparable and in most cases more superior proliferation profiles and cell number yields.

RNA Manufacture and Expression

In vitro transcribed (IVT) RNA coding for the CAR is prepared in-house using the T7 mScript™ RNA system (Cellscript, Madison Wis.), as per the manufacturer's instructions and as described previously (Zhao et al., Cancer Res. 70, 9053-9061, 2010). The IVT products are purified using a RNeasy® Mini Kit (Qiagen Inc, Valencia, Calif.) and the purified RNA is eluted into RNase-free water.

To obtain high expression of CAR on the cell surface, the IVT RNA is electroporated into primary human T cells (Zhao et al., Cancer Res. 70, 9053-9061, 2010). After letting the cells rest over-night and to allow for CAR-protein translation, surface expression of the CAR is examined by flow cytometry. The electroporation-based gene transfer technique allows for 95%+ CAR-positive T cells.

CAR T Cell Stimulation

After confirming CAR expression, the T cells are stimulated with a recombinant antigenic protein coupled to Dynabeads M-450 (Invitrogen, USA). Protein-bead coupling is carried out according to the manufacturer's protocol. Briefly, every 1 mL aliquot of $400e^6$ beads in incubated with 150 ug of protein overnight in sterile Borate solution (0.1M Boric acid, pH 9.5). After at least three washes, these beads are finally resuspended in R10 media (RPMI supplemented with 10% FCS, 100 U/mL penicillin, 100 ug/mL streptomycin sulfate). These beads are then used to stimulate the CAR T cells in media at a bead-to-cell ratio of 3:1.

Culture Maintenance

The cell culture is started at a concentration of $7.5 \times 10^5$ cells/mL of R10 media, supplemented with either IL2 (100 units/mL) or IL7 and IL15 (10 ng/mL each). Cell counts are measured every 48 hours, when they are fed with fresh media and re-plated at $7.5 \times 10^5$ cells/mL. This culture is maintained until two consecutive drops in cell-population doublings are noticed.

The CAR T cells incubated with the cognate antigen receive the initial stimulus to activate the T cells and proliferate in culture. Use of different CAR co-stimulatory domains show different effects on the growth profiles and differentiation of T cells when expanding in culture. Up to 9 total population doublings have been recorded, which corresponds to every cell multiplying to over 500 cells. These yields are comparable, and in some case, superior to the ones obtained using the traditional CD3/28 based stimulation system.

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (986 sequences)

SEQ ID NO: 1 - protein, 21 aa, Artificial Sequence
  Description of Artificial Sequence: Synthetic peptide
MALPVTALLLPLALLLHAARP

SEQ ID NO: 2 - protein, 45 aa, Artificial Sequence
  Description of Artificial Sequence: Synthetic polypeptide
TTTPAPRPPTPAPTIASQPLSLRPEACRPAAGGAVHTRGLDFACD

SEQ ID NO: 3 - DNA, 33 bp, Artificial Sequence
  Description of Artificial Sequence: Synthetic primer
ataggatcccagctggtggagtctgggggaggc

SEQ ID NO: 4 - DNA, 33 bp, Artificial Sequence
  Description of Artificial Sequence: Synthetic primer
atagctagcacctaggacggtcagcttggtccc

SEQ ID NO: 5 - protein, 1132 aa, Homo sapiens [sequence omitted]

SEQ ID NO: 6 - protein, 24 aa, Artificial Sequence
  Description of Artificial Sequence: Synthetic peptide
IYIWAPLAGTCGVLLLSLVITLYC

SEQ ID NO: 7 - protein, 42 aa, Artificial Sequence
  Description of Artificial Sequence: Synthetic polypeptide
KRGRKKLLYIFKQPFMRPVQTTQEEDGCSCRFPEEEEGGCEL

SEQ ID NO: 8 - DNA, 4027 bp, Homo sapiens
caggcagcgtggtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaa

SEQ ID NO: 9 - protein, 112 aa, Artificial Sequence
  Description of Artificial Sequence: Synthetic polypeptide
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11 - DNA, 1184 bp, Artificial Sequence
  Description of Artificial Sequence: Synthetic polynucleotide
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 12 - DNA, 63 bp, Artificial Sequence
  Description of Artificial Sequence: Synthetic oligonucleotide
atggccctgcctgtgacagccctgctgctgcctctggctctgctgctgcatgccgctagaccc

SEQ ID NO: 13 - DNA, 135 bp, Artificial Sequence
  Description of Artificial Sequence: Synthetic polynucleotide
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 14 - protein, 10 aa, Artificial Sequence
  Description of Artificial Sequence: Synthetic peptide
GGGGSGGGGS

SEQ ID NO: 15 - DNA, 123 bp, Artificial Sequence
  Description of Artificial Sequence: Synthetic polynucleotide
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 16 - protein, 48 aa, Artificial Sequence
  Description of Artificial Sequence: Synthetic polypeptide
QRRKYRSNKGESPVEPAEPCRYSCPREEEGSTIPIQEDYRKPEPACSP

SEQ ID NO: 17 - DNA, 72 bp, Artificial Sequence
  Description of Artificial Sequence: Synthetic oligonucleotide
atctacatctgggcgcccttggccgggacttgtggggtccttctcctgtcactggttatcaccctttactgc

SEQ ID NO: 18 - DNA, 126 bp, Artificial Sequence
  Description of Artificial Sequence: Synthetic polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 19 - DNA, 30 bp, Artificial Sequence
  Description of Artificial Sequence: Synthetic oligonucleotide
ggtggcggaggttctggaggtggaggttcc

SEQ ID NO: 20 - DNA, 336 bp, Artificial Sequence
  Description of Artificial Sequence: Synthetic polynucleotide
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 21 - DNA, 336 bp, Homo sapiens
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - protein, 40 aa, Artificial Sequence
  Description of Artificial Sequence: Synthetic polypeptide
  MISC_FEATURE (1)..(40): This sequence may encompass 1-10 'Gly Gly Gly Ser' repeating units
GGGSGGGSGGGSGGGSGGGSGGGSGGGSGGGSGGGSGGGS

SEQ ID NO: 23 - protein, 282 aa, Artificial Sequence
  Description of Artificial Sequence: Synthetic polypeptide
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 24 - DNA, 847 bp, Artificial Sequence
  Description of Artificial Sequence: Synthetic polynucleotide
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 25 - protein, 5 aa, Artificial Sequence
  Description of Artificial Sequence: Synthetic peptide
GGGGS

SEQ ID NO: 26 - protein, 30 aa, Artificial Sequence
  Description of Artificial Sequence: Synthetic polypeptide
  MISC_FEATURE (1)..(30): This sequence may encompass 1-6 'Gly Gly Gly Gly Ser' repeating units
GGGGSGGGGSGGGGSGGGGSGGGGSGGGGS

SEQ ID NO: 27 - protein, 20 aa, Artificial Sequence
  Description of Artificial Sequence: Synthetic peptide
GGGGSGGGGSGGGGSGGGGS

SEQ ID NO: 28 - protein, 15 aa, Artificial Sequence
  Description of Artificial Sequence: Synthetic peptide
GGGGSGGGGSGGGGS

SEQ ID NO: 29 - protein, 4 aa, Artificial Sequence
  Description of Artificial Sequence: Synthetic peptide
GGGS

SEQ ID NO: 30 - DNA, 5000 bp, Artificial Sequence
  Description of Artificial Sequence: Synthetic polynucleotide
  misc_feature (1)..(5000): This sequence may encompass 50-5000 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 31 - DNA, 100 bp, Artificial Sequence
  Description of Artificial Sequence: Synthetic polynucleotide
tttttttttttttttttttttttttttttttttttttttttttttttttttttttttttttttttttttttttttttttttttttttttttttttttttt

SEQ ID NO: 32 - DNA, 5000 bp, Artificial Sequence
  Description of Artificial Sequence: Synthetic polynucleotide
  misc_feature (1)..(5000): This sequence may encompass 50-5000 nucleotides
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 33 - DNA, 5000 bp, Artificial Sequence; identical to SEQ ID NO: 30
  Description of Artificial Sequence: Synthetic polynucleotide
  misc_feature (1)..(5000): This sequence may encompass 100-5000 nucleotides

SEQ ID NO: 34 - DNA, 400 bp, Artificial Sequence
  Description of Artificial Sequence: Synthetic polynucleotide
  misc_feature (1)..(400): This sequence may encompass 100-400 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 2000 bp, Artificial Sequence
  Description of Artificial Sequence: Synthetic polynucleotide
  misc_feature (1)..(2000): This sequence may encompass 50-2000 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 36 - protein, 230 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 37 - DNA, 690 bp, Artificial Sequence
  Description of Artificial Sequence: Synthetic polynucleotide
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 38 - protein, 40 aa, Artificial Sequence; identical to SEQ ID NO: 22
  Description of Artificial Sequence: Synthetic polypeptide
  MISC_FEATURE (1)..(40): This sequence may encompass 1-10 'Gly Gly Gly Ser' repeating units

SEQ ID NO: 39 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 40 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 41 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 42 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 43 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 44 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 45 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 46 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 47 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 48 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 49 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 50 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 51 - protein, 242 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 52 - DNA, 813 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 53 - DNA, 813 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 54 - DNA, 813 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 55 - DNA, 813 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 56 - DNA, 828 bp, Artificial Sequence
  Description of Artificial Sequence: Synthetic polynucleotide
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactactcttcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 57 - DNA, 828 bp, Artificial Sequence
  Description of Artificial Sequence: Synthetic polynucleotide
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactaccagtcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 58 - DNA, 828 bp, Artificial Sequence
  Description of Artificial Sequence: Synthetic polynucleotide
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactactcatcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 59 - DNA, 828 bp, Artificial Sequence
  Description of Artificial Sequence: Synthetic polynucleotide
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactaccagtcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcatcaccac

SEQ ID NO: 60 - DNA, 828 bp, Artificial Sequence
  Description of Artificial Sequence: Synthetic polynucleotide
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactacaattcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 61 - DNA, 828 bp, Artificial Sequence
  Description of Artificial Sequence: Synthetic polynucleotide
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactacaactcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 62 - DNA, 813 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaattcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 63 - DNA, 813 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 64 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 65 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 66 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 67 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 68 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 69 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 70 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 71 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 72 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 73 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 74 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 75 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 76 - protein, 271 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSHHHHHHHH

SEQ ID NO: 77 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 78 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 79 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 80 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 81 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 82 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 83 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 84 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 85 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 86 - protein, 491 aa, Artificial Sequence; identical to SEQ ID NO: 85
  Description of Artificial Sequence: Synthetic polypeptide

SEQ ID NO: 87 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 88 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 89 - protein, 486 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 90 - DNA, 1458 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 91 - DNA, 1458 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 92 - DNA, 1458 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 93 - DNA, 1458 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 94 - DNA, 1473 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggcggaggcgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 95 - DNA, 1473 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggagggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 96 - DNA, 1473 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 97 - DNA, 1473 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggcggtgggtcagaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 98 - DNA, 1473 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggtgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 99 - DNA, 1473 bp, Artificial Sequence; identical to SEQ ID NO: 98
  Description of Artificial Sequence: Synthetic polynucleotide

SEQ ID NO: 100 - DNA, 1473 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 101 - DNA, 1458 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 102 - DNA, 1458 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 103 - DNA, 1182 bp, Artificial Sequence
  Description of Artificial Sequence: Synthetic polynucleotide
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 104 - protein, 18 aa, Artificial Sequence
  Description of Artificial Sequence: Synthetic peptide
GSTSGSGKPGSGEGSTKG

SEQ ID NO: 105 - protein, 394 aa, Artificial Sequence
  Description of Artificial Sequence: Synthetic polypeptide
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 106 - protein, 373 aa, Artificial Sequence
  Description of Artificial Sequence: Synthetic polypeptide
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 107 - protein, 242 aa, Artificial Sequence; identical to SEQ ID NO: 39
  Description of Artificial Sequence: Synthetic polypeptide

SEQ ID NO: 108 - protein, 242 aa, Artificial Sequence; identical to SEQ ID NO: 40
  Description of Artificial Sequence: Synthetic polypeptide

SEQ ID NO: 109 - protein, 242 aa, Artificial Sequence; identical to SEQ ID NO: 41
  Description of Artificial Sequence: Synthetic polypeptide

SEQ ID NO: 110 - protein, 242 aa, Artificial Sequence; identical to SEQ ID NO: 42
  Description of Artificial Sequence: Synthetic polypeptide

SEQ ID NO: 111 - protein, 247 aa, Artificial Sequence; identical to SEQ ID NO: 43
  Description of Artificial Sequence: Synthetic polypeptide

SEQ ID NO: 112 - protein, 247 aa, Artificial Sequence; identical to SEQ ID NO: 44
  Description of Artificial Sequence: Synthetic polypeptide

SEQ ID NO: 113 - protein, 247 aa, Artificial Sequence; identical to SEQ ID NO: 45
  Description of Artificial Sequence: Synthetic polypeptide

SEQ ID NO: 114 - protein, 247 aa, Artificial Sequence; identical to SEQ ID NO: 46
  Description of Artificial Sequence: Synthetic polypeptide

SEQ ID NO: 115 - protein, 247 aa, Artificial Sequence; identical to SEQ ID NO: 47
  Description of Artificial Sequence: Synthetic polypeptide

SEQ ID NO: 116 - protein, 247 aa, Artificial Sequence; identical to SEQ ID NO: 48
  Description of Artificial Sequence: Synthetic polypeptide

SEQ ID NO: 117 - protein, 242 aa, Artificial Sequence; identical to SEQ ID NO: 49
  Description of Artificial Sequence: Synthetic polypeptide

SEQ ID NO: 118 - protein, 242 aa, Artificial Sequence; identical to SEQ ID NO: 50
  Description of Artificial Sequence: Synthetic polypeptide

SEQ ID NO: 119 - protein, 242 aa, Artificial Sequence; identical to SEQ ID NO: 51
  Description of Artificial Sequence: Synthetic polypeptide

SEQ ID NO: 120 - protein, 119 aa, Artificial Sequence
  Description of Artificial Sequence: Synthetic polypeptide
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 121 - protein, 111 aa, Artificial Sequence
  Description of Artificial Sequence: Synthetic polypeptide
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 122 - protein, 5 aa, Artificial Sequence
  Description of Artificial Sequence: Synthetic peptide
DYGVS

SEQ ID NO: 123 - protein, 16 aa, Artificial Sequence
  Description of Artificial Sequence: Synthetic peptide
VIWGSETTYYNSALKS

SEQ ID NO: 124 - protein, 16 aa, Artificial Sequence
  Description of Artificial Sequence: Synthetic peptide
VIWGSETTYYSSSLKS

SEQ ID NO: 125 - protein, 16 aa, Artificial Sequence
  Description of Artificial Sequence: Synthetic peptide
VIWGSETTYYQSSLKS

SEQ ID NO: 126 - protein, 16 aa, Artificial Sequence
  Description of Artificial Sequence: Synthetic peptide
VIWGSETTYYNSSLKS

SEQ ID NO: 127 - protein, 12 aa, Artificial Sequence
  Description of Artificial Sequence: Synthetic peptide
HYYYGGSYAMDY

SEQ ID NO: 128 - protein, 11 aa, Artificial Sequence
  Description of Artificial Sequence: Synthetic peptide
RASQDISKYLN

SEQ ID NO: 129 - protein, 7 aa, Artificial Sequence
  Description of Artificial Sequence: Synthetic peptide
HTSRLHS

SEQ ID NO: 130 - protein, 9 aa, Artificial Sequence
  Description of Artificial Sequence: Synthetic peptide
QQGNTLPYT

SEQ ID NO: 131 - protein, 132 aa, Artificial Sequence
  Description of Artificial Sequence: Synthetic polypeptide
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 132 - protein, 108 aa, Artificial Sequence
  Description of Artificial Sequence: Synthetic polypeptide
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 133 - protein, 93 aa, Artificial Sequence [sequence omitted]

SEQ ID NO: 134 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 135 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 136 - protein, 95 aa, Artificial Sequence
  Description of Artificial Sequence: Synthetic polypeptide
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 137 - protein, 95 aa, Artificial Sequence
  Description of Artificial Sequence: Synthetic polypeptide
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 138 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 139 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 140 - protein, 4 aa, Artificial Sequence
  Description of Artificial Sequence: Synthetic peptide
RGDS

SEQ ID NO: 141 - DNA, 813 bp, Artificial Sequence
  Description of Artificial Sequence: Synthetic polynucleotide
atggccctgcccgtcaccgctctgctgctgccccttgctctgcttcttcatgcagcaaggccggacatccagatgacccaaaccacctcatccctctctgcctctcttggagacagggtgaccatttcttgtcgcgccagccaggacatcagcaagtatctgaactggtatcagcagaagccggacggaaccgtgaagctcctgatctaccatacctctcgcctgcatagcggcgtgccctcacgcttctctggaagcggatcaggaaccgattattctctcactatttcaaatcttgagcaggaagatattgccacctatttctgccagcagggtaataccctgccctacaccttcggaggagggaccaagctcgaaatcaccggtggaggaggcagcggcggtggagggtctggtggaggtggttctgaggtgaagctgcaagaatcaggccctggacttgtggccccttcacagtccctgagcgtgacttgcaccgtgtccggagtctccctgcccgactacggagtgtcatggatcagacaacctccacggaaaggactggaatggctcggtgtcatctggggtagcgaaactacttactacaattcagccctcaaaagcaggctgactattatcaaggacaacagcaagtcccaagtctttcttaagatgaactcactccagactgacgacaccgcaatctactattgtgctaagcactactactacggaggatcctacgctatggattactggggacaaggtacttccgtcactgtctcttcacaccatcatcaccatcaccatcac

SEQ ID NO: 142 - protein, 249 aa, Artificial Sequence
  Description of Artificial Sequence: Synthetic polypeptide
DIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 143 - DNA, 747 bp, Artificial Sequence
  Description of Artificial Sequence: Synthetic polynucleotide
gacatcgtgctgacccaatccccggacagcctcgcagtctcactcggagaacgcgccactatcaattgtagggcgtcggagtccgtggacaattacggaaacaccttcatgcactggtaccaacaaaaacctggtcagccacctaagctgctgatctaccgcgcctcgaatctggaatcaggagtgccggacagattctcggggtccggctcccggacggatttcactttgaccatctcgtcacttcaagctgaggacgtcgcggtgtactactgccagcagagcaacgaagatccacccacgttcggacaaggcaccaagctggagattaaaggaggcggaggctccggtggaggaggatcgggaggaggcggctccggcggaggtggatcgcagattcagctggtgcagtcgggttcagaattgaagaaaccaggagcctcggtgaaggtcagctgcaaggcatcagggtacatcttcactaactacggcatgaactgggtgcgccaggctccgggacaggggctggagtggatgggatggatcaacacttacaccggggagtcaacttactcggctgactttaagggccggtttgtgttctccctcgacactagcgtgagcaccgcctatcttcaaatcaacgccctcaaggcggaagataccgccgtctactactgcgcaagatccggtgggtacgatccgatggattattggggacagggaaccactgtcaccgtgagcagc

SEQ ID NO: 144 - DNA, 843 bp, Artificial Sequence
  Description of Artificial Sequence: Synthetic polynucleotide
atggccctccctgtcaccgccctgctgcttccgctggctcttctgctccacgccgctcggcccgacatcgtgctgacccaatccccggacagcctcgcagtctcactcggagaacgcgccactatcaattgtagggcgtcggagtccgtggacaattacggaaacaccttcatgcactggtaccaacaaaaacctggtcagccacctaagctgctgatctaccgcgcctcgaatctggaatcaggagtgccggacagattctcggggtccggctcccggacggatttcactttgaccatctcgtcacttcaagctgaggacgtcgcggtgtactactgccagcagagcaacgaagatccacccacgttcggacaaggcaccaagctggagattaaaggaggcggaggctccggtggaggaggatcgggaggaggcggctccggcggaggtggatcgcagattcagctggtgcagtcgggttcagaattgaagaaaccaggagcctcggtgaaggtcagctgcaaggcatcagggtacatcttcactaactacggcatgaactgggtgcgccaggctccgggacaggggctggagtggatgggatggatcaacacttacaccggggagtcaacttactcggctgactttaagggccggtttgtgttctccctcgacactagcgtgagcaccgcctatcttcaaatcaacgccctcaaggcggaagataccgccgtctactactgcgcaagatccggtgggtacgatccgatggattattggggacagggaaccactgtcaccgtgagcagcggctcgcaccaccatcaccatcatcatcaccac

SEQ ID NO: 145 - protein, 281 aa, Artificial Sequence
  Description of Artificial Sequence: Synthetic polypeptide
MALPVTALLLPLALLLHAARPDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGSHHHHHHHHH

SEQ ID NO: 146 - DNA, 1479 bp, Artificial Sequence
  Description of Artificial Sequence: Synthetic polynucleotide
atggccctccctgtcaccgccctgctgcttccgctggctcttctgctccacgccgctcggcccgacatcgtgctgacccaatccccggacagcctcgcagtctcactcggagaacgcgccactatcaattgtagggcgtcggagtccgtggacaattacggaaacaccttcatgcactggtaccaacaaaaacctggtcagccacctaagctgctgatctaccgcgcctcgaatctggaatcaggagtgccggacagattctcggggtccggctcccggacggatttcactttgaccatctcgtcacttcaagctgaggacgtcgcggtgtactactgccagcagagcaacgaagatccacccacgttcggacaaggcaccaagctggagattaaaggaggcggaggctccggtggaggaggatcgggaggaggcggctccggcggaggtggatcgcagattcagctggtgcagtcgggttcagaattgaagaaaccaggagcctcggtgaaggtcagctgcaaggcatcagggtacatcttcactaactacggcatgaactgggtgcgccaggctccgggacaggggctggagtggatgggatggatcaacacttacaccggggagtcaacttactcggctgactttaagggccggtttgtgttctccctcgacactagcgtgagcaccgcctatcttcaaatcaacgccctcaaggcggaagataccgccgtctactactgcgcaagatccggtgggtacgatccgatggattattggggacagggaaccactgtcaccgtgagcagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 147 - protein, 493 aa, Artificial Sequence
  Description of Artificial Sequence: Synthetic polypeptide
MALPVTALLLPLALLLHAARPDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 148 - protein, 249 aa, Artificial Sequence
  Description of Artificial Sequence: Synthetic polypeptide
DIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 149 - DNA, 747 bp, Artificial Sequence
  Description of Artificial Sequence: Synthetic polynucleotide
gatattgtcctcactcaatcgccggactcactggcggtgtccctcggagagagggcgacgatcaattgccgggcttccgaatccgtcgataactacggaaacacctttatgcactggtaccaacagaagccaggacagccaccaaagctgttgatctaccgcgcttcaaaccttgagtcgggtgtgccggaccgcttcagcggcagcggttccagaaccgactttaccctcaccatcagctcgctgcaggccgaagatgtcgccgtctattactgccaacagagcaacgaagatccgcctactttcggacaggggactaaactggaaatcaagggcggaggaggctcgggtggaggaggatcgggaggaggcgggtccggtggtggcggatcgcaaatccagctggtgcagtccggcgcagaagtgaagaagccgggagcgtccgtgaaagtgagctgcaaggcctcagggtacatcttcaccaattacggcatgaattgggtgcggcaggcacccggacagcgcctggagtggatgggctggatcaacacttacaccggggaaagcacgtactcggccgacttcaaaggacgggtgaccattaccctggatacctcggcctcaaccgcttacatggagctctcatcacttagatccgaggacactgccgtctactactgtgcaaggagcggaggctacgaccctatggactattggggacaaggcactactgtgactgtgtcgtcc

SEQ ID NO: 150 - DNA, 843 bp, Artificial Sequence
  Description of Artificial Sequence: Synthetic polynucleotide
atggccctccctgtcaccgccctgctgcttccgctggctcttctgctccacgccgctcggcccgatattgtcctcactcaatcgccggactcactggcggtgtccctcggagagagggcgacgatcaattgccgggcttccgaatccgtcgataactacggaaacacctttatgcactggtaccaacagaagccaggacagccaccaaagctgttgatctaccgcgcttcaaaccttgagtcgggtgtgccggaccgcttcagcggcagcggttccagaaccgactttaccctcaccatcagctcgctgcaggccgaagatgtcgccgtctattactgccaacagagcaacgaagatccgcctactttcggacaggggactaaactggaaatcaagggcggaggaggctcgggtggaggaggatcgggaggaggcgggtccggtggtggcggatcgcaaatccagctggtgcagtccggcgcagaagtgaagaagccgggagcgtccgtgaaagtgagctgcaaggcctcagggtacatcttcaccaattacggcatgaattgggtgcggcaggcacccggacagcgcctggagtggatgggctggatcaacacttacaccggggaaagcacgtactcggccgacttcaaaggacgggtgaccattaccctggatacctcggcctcaaccgcttacatggagctctcatcacttagatccgaggacactgccgtctactactgtgcaaggagcggaggctacgaccctatggactattggggacaaggcactactgtgactgtgtcgtccggctcgcaccaccatcaccatcatcatcaccac

SEQ ID NO: 151 - protein, 281 aa, Artificial Sequence
  Description of Artificial Sequence: Synthetic polypeptide
MALPVTALLLPLALLLHAARPDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGSHHHHHHHHH

SEQ ID NO: 152 - DNA, 1479 bp, Artificial Sequence
  Description of Artificial Sequence: Synthetic polynucleotide
atggccctccctgtcaccgccctgctgcttccgctggctcttctgctccacgccgctcggcccgatattgtcctcactcaatcgccggactcactggcggtgtccctcggagagagggcgacgatcaattgccgggcttccgaatccgtcgataactacggaaacacctttatgcactggtaccaacagaagccaggacagccaccaaagctgttgatctaccgcgcttcaaaccttgagtcgggtgtgccggaccgcttcagcggcagcggttccagaaccgactttaccctcaccatcagctcgctgcaggccgaagatgtcgccgtctattactgccaacagagcaacgaagatccgcctactttcggacaggggactaaactggaaatcaagggcggaggaggctcgggtggaggaggatcgggaggaggcgggtccggtggtggcggatcgcaaatccagctggtgcagtccggcgcagaagtgaagaagccgggagcgtccgtgaaagtgagctgcaaggcctcagggtacatcttcaccaattacggcatgaattgggtgcggcaggcacccggacagcgcctggagtggatgggctggatcaacacttacaccggggaaagcacgtactcggccgacttcaaaggacgggtgaccattaccctggatacctcggcctcaaccgcttacatggagctctcatcacttagatccgaggacactgccgtctactactgtgcaaggagcggaggctacgaccctatggactattggggacaaggcactactgtgactgtgtcgtccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 153 - protein, 493 aa, Artificial Sequence
  Description of Artificial Sequence: Synthetic polypeptide
MALPVTALLLPLALLLHAARPDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 154 - protein, 249 aa, Artificial Sequence
  Description of Artificial Sequence: Synthetic polypeptide
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 155 - DNA, 747 bp, Artificial Sequence
  Description of Artificial Sequence: Synthetic polynucleotide
gaaattgtgctcacgcaatcacccgccactctgtcgctttccccgggagagcgggccaccctctcctgccgcgcttcggaatcggtcgacaattacggaaatacttttatgcactggtaccaacagaagccagggcaggcgccaaggctgctgatctacagagcctcgaacctcgaaagcggcatccctgcgcggttcagcggtagcggaagccgcaccgatttcaccctgaccatctcatcactggagccggaggatgtggcagtgtactattgtcagcagtcgaacgaggacccgccgactttcgggcagggaaccaagctggaaatcaagggtggaggagggagcggcggaggaggatcgggaggaggaggcagcggaggcggaggatcgcaaatccaacttgtccagtcgggctccgaactcaaaaagcctggcgcgtccgtgaaggtcagctgcaaagcatcaggatacatcttcactaactacggtatgaattgggtcagacaggctccgggtcagggtctggagtggatgggatggattaacacctacactggggaatcgacttactccgcggacttcaaagggcggttcgtgttttcactggacaccagcgtgtccaccgcttacttgcaaatcaacgccctcaaggccgaggacaccgccgtgtactactgcgcacgctcaggcggatacgatccaatggactactggggacagggcactacggtgactgtgtcctcc

SEQ ID NO: 156 - DNA, 843 bp, Artificial Sequence
  Description of Artificial Sequence: Synthetic polynucleotide
atggccctccctgtcaccgccctgctgcttccgctggctcttctgctccacgccgctcggcccgaaattgtgctcacgcaatcacccgccactctgtcgctttccccgggagagcgggccaccctctcctgccgcgcttcggaatcggtcgacaattacggaaatacttttatgcactggtaccaacagaagccagggcaggcgccaaggctgctgatctacagagcctcgaacctcgaaagcggcatccctgcgcggttcagcggtagcggaagccgcaccgatttcaccctgaccatctcatcactggagccggaggatgtggcagtgtactattgtcagcagtcgaacgaggacccgccgactttcgggcagggaaccaagctggaaatcaagggtggaggagggagcggcggaggaggatcgggaggaggaggcagcggaggcggaggatcgcaaatccaacttgtccagtcgggctccgaactcaaaaagcctggcgcgtccgtgaaggtcagctgcaaagcatcaggatacatcttcactaactacggtatgaattgggtcagacaggctccgggtcagggtctggagtggatgggatggattaacacctacactggggaatcgacttactccgcggacttcaaagggcggttcgtgttttcactggacaccagcgtgtccaccgcttacttgcaaatcaacgccctcaaggccgaggacaccgccgtgtactactgcgcacgctcaggcggatacgatccaatggactactggggacagggcactacggtgactgtgtcctccggctcgcaccaccatcaccatcatcatcaccac

SEQ ID NO: 157 - protein, 281 aa, Artificial Sequence
  Description of Artificial Sequence: Synthetic polypeptide
MALPVTALLLPLALLLHAARPEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGSHHHHHHHHH

SEQ ID NO: 158 - DNA, 1479 bp, Artificial Sequence
  Description of Artificial Sequence: Synthetic polynucleotide
atggccctccctgtcaccgccctgctgcttccgctggctcttctgctccacgccgctcggcccgaaattgtgctcacgcaatcacccgccactctgtcgctttccccgggagagcgggccaccctctcctgccgcgcttcggaatcggtcgacaattacggaaatacttttatgcactggtaccaacagaagccagggcaggcgccaaggctgctgatctacagagcctcgaacctcgaaagcggcatccctgcgcggttcagcggtagcggaagccgcaccgatttcaccctgaccatctcatcactggagccggaggatgtggcagtgtactattgtcagcagtcgaacgaggacccgccgactttcgggcagggaaccaagctggaaatcaagggtggaggagggagcggcggaggaggatcgggaggaggaggcagcggaggcggaggatcgcaaatccaacttgtccagtcgggctccgaactcaaaaagcctggcgcgtccgtgaaggtcagctgcaaagcatcaggatacatcttcactaactacggtatgaattgggtcagacaggctccgggtcagggtctggagtggatgggatggattaacacctacactggggaatcgacttactccgcggacttcaaagggcggttcgtgttttcactggacaccagcgtgtccaccgcttacttgcaaatcaacgccctcaaggccgaggacaccgccgtgtactactgcgcacgctcaggcggatacgatccaatggactactggggacagggcactacggtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 159 - protein, 493 aa, Artificial Sequence
  Description of Artificial Sequence: Synthetic polypeptide
MALPVTALLLPLALLLHAARPEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 160 - protein, 249 aa, Artificial Sequence
  Description of Artificial Sequence: Synthetic polypeptide
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 161 - DNA, 747 bp, Artificial Sequence
  Description of Artificial Sequence: Synthetic polynucleotide
gagatcgtcttgacgcaatcgccagccaccctgtccctgagcccaggcgagcgcgccaccctcagctgtcgggcgagcgaaagcgtggacaattacggaaacacctttatgcactggtaccaacagaaaccggggcaggctccgcgcctcctcatctaccgcgcatccaatctggaatcaggaatccccgcgaggttctccggtagcggatcgcggactgactttactctgaccatctcgtcccttgaaccggaggatgtggctgtgtattactgccagcagtcaaacgaggaccctccaactttcgggcagggaaccaagctcgaaatcaagggcggtggcggaagcggaggaggaggatcaggcggaggcggctcaggcggtggaggttcacaaattcaactggtgcagtcgggagcggaggtcaagaagccgggagcctcagtgaaagtgagctgcaaggcttcgggttacattttcactaattacggcatgaactgggtgaggcaggcccctggccaacggttggaatggatgggatggatcaacacctacaccggggagtcgacttactccgcggacttcaaggggagagtcacgatcaccctggatacgtccgcaagcactgcctacatggaactgtcctccctgcgctcggaagataccgcagtctactactgcgccagatcgggcggatatgacccgatggactactggggacagggaactactgtcaccgtgtcctcg

SEQ ID NO: 162 - DNA, 843 bp, Artificial Sequence
  Description of Artificial Sequence: Synthetic polynucleotide
atggccctccctgtcaccgccctgctgcttccgctggctcttctgctccacgccgctcggcccgagatcgtcttgacgcaatcgccagccaccctgtccctgagcccaggcgagcgcgccaccctcagctgtcgggcgagcgaaagcgtggacaattacggaaacacctttatgcactggtaccaacagaaaccggggcaggctccgcgcctcctcatctaccgcgcatccaatctggaatcaggaatccccgcgaggttctccggtagcggatcgcggactgactttactctgaccatctcgtcccttgaaccggaggatgtggctgtgtattactgccagcagtcaaacgaggaccctccaactttcgggcagggaaccaagctcgaaatcaagggcggtggcggaagcggaggaggaggatcaggcggaggcggctcaggcggtggaggttcacaaattcaactggtgcagtcgggagcggaggtcaagaagccgggagcctcagtgaaagtgagctgcaaggcttcgggttacattttcactaattacggcatgaactgggtgaggcaggcccctggccaacggttggaatggatgggatggatcaacacctacaccggggagtcgacttactccgcggacttcaaggggagagtcacgatcaccctggatacgtccgcaagcactgcctacatggaactgtcctccctgcgctcggaagataccgcagtctactactgcgccagatcgggcggatatgacccgatggactactggggacagggaactactgtcaccgtgtcctcgggctcgcaccaccatcaccatcatcatcaccac

SEQ ID NO: 163 - protein, 281 aa, Artificial Sequence
  Description of Artificial Sequence: Synthetic polypeptide
MALPVTALLLPLALLLHAARPEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGSHHHHHHHHH

SEQ ID NO: 164 - DNA, 1479 bp, Artificial Sequence
  Description of Artificial Sequence: Synthetic polynucleotide
atggccctccctgtcaccgccctgctgcttccgctggctcttctgctccacgccgctcggcccgagatcgtcttgacgcaatcgccagccaccctgtccctgagcccaggcgagcgcgccaccctcagctgtcgggcgagcgaaagcgtggacaattacggaaacacctttatgcactggtaccaacagaaaccggggcaggctccgcgcctcctcatctaccgcgcatccaatctggaatcaggaatccccgcgaggttctccggtagcggatcgcggactgactttactctgaccatctcgtcccttgaaccggaggatgtggctgtgtattactgccagcagtcaaacgaggaccctccaactttcgggcagggaaccaagctcgaaatcaagggcggtggcggaagcggaggaggaggatcaggcggaggcggctcaggcggtggaggttcacaaattcaactggtgcagtcgggagcggaggtcaagaagccgggagcctcagtgaaagtgagctgcaaggcttcgggttacattttcactaattacggcatgaactgggtgaggcaggcccctggccaacggttggaatggatgggatggatcaacacctacaccggggagtcgacttactccgcggacttcaaggggagagtcacgatcaccctggatacgtccgcaagcactgcctacatggaactgtcctccctgcgctcggaagataccgcagtctactactgcgccagatcgggcggatatgacccgatggactactggggacagggaactactgtcaccgtgtcctcgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 165 - protein, 493 aa, Artificial Sequence
  Description of Artificial Sequence: Synthetic polypeptide
MALPVTALLLPLALLLHAARPEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 166 - protein, 249 aa, Artificial Sequence
  Description of Artificial Sequence: Synthetic polypeptide
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 167 - DNA, 747 bp, Artificial Sequence
  Description of Artificial Sequence: Synthetic polynucleotide
cagatccagttggtccagtcaggctccgaactgaaaaagccgggtgcatccgtcaaggtgtcgtgcaaagcctccggttacattttcaccaactacggcatgaactgggtccgccaggcccctgggcagggactcgaatggatggggtggatcaacacttacaccggagagtcgacttactcggccgatttcaagggacggttcgtgttttccctggacacttcagtctcgaccgcatatctccaaatcaacgcgcttaaggcggaagatactgctgtctactactgcgccagatcaggaggttacgatccaatggactactggggacagggcaccactgtgacggtgtcgtcgggaggaggaggatcgggcggaggcgggtccggcggtggagggagcggaggaggcggaagcgacatcgtgctgacccagtcgccagatagcctggcggtgtccttgggtgagagggctaccatcaattgtcgcgcgtcagagtccgtggacaattacgggaataccttcatgcactggtaccaacaaaagcccggacaaccgccgaagctgctgatctacagagcaagcaacctcgaatcaggagtgccggaccgctttagcgggtcaggaagccggactgacttcaccctgactatctcctcgctccaggccgaggacgtggccgtgtattactgccagcagagcaacgaagatcctccaacgttcggccaaggaaccaaactggagattaag

SEQ ID NO: 168 - DNA, 843 bp, Artificial Sequence
  Description of Artificial Sequence: Synthetic polynucleotide
atggccctccctgtcaccgccctgctgcttccgctggctcttctgctccacgccgctcggccccagatccagttggtccagtcaggctccgaactgaaaaagccgggtgcatccgtcaaggtgtcgtgcaaagcctccggttacattttcaccaactacggcatgaactgggtccgccaggcccctgggcagggactcgaatggatggggtggatcaacacttacaccggagagtcgacttactcggccgatttcaagggacggttcgtgttttccctggacacttcagtctcgaccgcatatctccaaatcaacgcgcttaaggcggaagatactgctgtctactactgcgccagatcaggaggttacgatccaatggactactggggacagggcaccactgtgacggtgtcgtcgggaggaggaggatcgggcggaggcgggtccggcggtggagggagcggaggaggcggaagcgacatcgtgctgacccagtcgccagatagcctggcggtgtccttgggtgagagggctaccatcaattgtcgcgcgtcagagtccgtggacaattacgggaataccttcatgcactggtaccaacaaaagcccggacaaccgccgaagctgctgatctacagagcaagcaacctcgaatcaggagtgccggaccgctttagcgggtcaggaagccggactgacttcaccctgactatctcctcgctccaggccgaggacgtggccgtgtattactgccagcagagcaacgaagatcctccaacgttcggccaaggaaccaaactggagattaagggctcgcaccaccatcaccatcatcatcaccac

SEQ ID NO: 169 - protein, 281 aa, Artificial Sequence
  Description of Artificial Sequence: Synthetic polypeptide
MALPVTALLLPLALLLHAARPQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGSHHHHHHHHH

SEQ ID NO: 170 - DNA, 1479 bp, Artificial Sequence
  Description of Artificial Sequence: Synthetic polynucleotide
atggccctccctgtcaccgccctgctgcttccgctggctcttctgctccacgccgctcggccccagatccagttggtccagtcaggctccgaactgaaaaagccgggtgcatccgtcaaggtgtcgtgcaaagcctccggttacattttcaccaactacggcatgaactgggtccgccaggcccctgggcagggactcgaatggatggggtggatcaacacttacaccggagagtcgacttactcggccgatttcaagggacggttcgtgttttccctggacacttcagtctcgaccgcatatctccaaatcaacgcgcttaaggcggaagatactgctgtctactactgcgccagatcaggaggttacgatccaatggactactggggacagggcaccactgtgacggtgtcgtcgggaggaggaggatcgggcggaggcgggtccggcggtggagggagcggaggaggcggaagcgacatcgtgctgacccagtcgccagatagcctggcggtgtccttgggtgagagggctaccatcaattgtcgcgcgtcagagtccgtggacaattacgggaataccttcatgcactggtaccaacaaaagcccggacaaccgccgaagctgctgatctacagagcaagcaacctcgaatcaggagtgccggaccgctttagcgggtcaggaagccggactgacttcaccctgactatctcctcgctccaggccgaggacgtggccgtgtattactgccagcagagcaacgaagatcctccaacgttcggccaaggaaccaaactggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 171 - protein, 493 aa, Artificial Sequence
  Description of Artificial Sequence: Synthetic polypeptide
MALPVTALLLPLALLLHAARPQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - protein, 249 aa, Artificial Sequence
  Description of Artificial Sequence: Synthetic polypeptide
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 173 - DNA, 747 bp, Artificial Sequence
  Description of Artificial Sequence: Synthetic polynucleotide
cagatccaactggtgcaatcaggatcggagctgaagaagcctggggcttcagtgaaagtcagctgcaaagcctccggttacatcttcaccaactacggcatgaactgggtgcgccaggcccctggacagggactcgaatggatggggtggatcaacacctataccggggaatccacgtactcagcagatttcaagggacgcttcgtcttttcgctggatacctccgtgtccactgcgtacctccaaatcaatgccctcaaagccgaagatactgcggtctactactgcgcacggagcggaggctacgacccgatggactactggggacagggaaccacggtgaccgtgtccagcggaggaggcggatcgggaggcggtggttcaggcggtggaggcagcggcggaggtggaagcgaaatcgtcttgactcagagcccagcgactttgtccctgtcgcccggagagcgggcaactctgtcatgccgcgcttcggaatcggtggacaactatggaaacacctttatgcactggtaccaacagaagccgggacaagccccgagacttctgatctaccgggcctcgaatctcgaaagcggcatcccggctagattctcggggtcgggatcaaggaccgacttcactcttactatttcctcactggagccagaagatgtggcggtgtactactgtcagcagtccaatgaggacccgccaactttcgggcagggcaccaagctggagattaag

SEQ ID NO: 174 - DNA, 843 bp, Artificial Sequence
  Description of Artificial Sequence: Synthetic polynucleotide
atggccctccctgtcaccgccctgctgcttccgctggctcttctgctccacgccgctcggccccagatccaactggtgcaatcaggatcggagctgaagaagcctggggcttcagtgaaagtcagctgcaaagcctccggttacatcttcaccaactacggcatgaactgggtgcgccaggcccctggacagggactcgaatggatggggtggatcaacacctataccggggaatccacgtactcagcagatttcaagggacgcttcgtcttttcgctggatacctccgtgtccactgcgtacctccaaatcaatgccctcaaagccgaagatactgcggtctactactgcgcacggagcggaggctacgacccgatggactactggggacagggaaccacggtgaccgtgtccagcggaggaggcggatcgggaggcggtggttcaggcggtggaggcagcggcggaggtggaagcgaaatcgtcttgactcagagcccagcgactttgtccctgtcgcccggagagcgggcaactctgtcatgccgcgcttcggaatcggtggacaactatggaaacacctttatgcactggtaccaacagaagccgggacaagccccgagacttctgatctaccgggcctcgaatctcgaaagcggcatcccggctagattctcggggtcgggatcaaggaccgacttcactcttactatttcctcactggagccagaagatgtggcggtgtactactgtcagcagtccaatgaggacccgccaactttcgggcagggcaccaagctggagattaagggctcgcaccaccatcaccatcatcatcaccac

SEQ ID NO: 175 - protein, 281 aa, Artificial Sequence
  Description of Artificial Sequence: Synthetic polypeptide
MALPVTALLLPLALLLHAARPQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGSHHHHHHHHH

SEQ ID NO: 176 - DNA, 1479 bp, Artificial Sequence
  Description of Artificial Sequence: Synthetic polynucleotide
atggccctccctgtcaccgccctgctgcttccgctggctcttctgctccacgccgctcggccccagatccaactggtgcaatcaggatcggagctgaagaagcctggggcttcagtgaaagtcagctgcaaagcctccggttacatcttcaccaactacggcatgaactgggtgcgccaggcccctggacagggactcgaatggatggggtggatcaacacctataccggggaatccacgtactcagcagatttcaagggacgcttcgtcttttcgctggatacctccgtgtccactgcgtacctccaaatcaatgccctcaaagccgaagatactgcggtctactactgcgcacggagcggaggctacgacccgatggactactggggacagggaaccacggtgaccgtgtccagcggaggaggcggatcgggaggcggtggttcaggcggtggaggcagcggcggaggtggaagcgaaatcgtcttgactcagagcccagcgactttgtccctgtcgcccggagagcgggcaactctgtcatgccgcgcttcggaatcggtggacaactatggaaacacctttatgcactggtaccaacagaagccgggacaagccccgagacttctgatctaccgggcctcgaatctcgaaagcggcatcccggctagattctcggggtcgggatcaaggaccgacttcactcttactatttcctcactggagccagaagatgtggcggtgtactactgtcagcagtccaatgaggacccgccaactttcgggcagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 177 - protein, 493 aa, Artificial Sequence
  Description of Artificial Sequence: Synthetic polypeptide
MALPVTALLLPLALLLHAARPQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 178 - protein, 249 aa, Artificial Sequence
  Description of Artificial Sequence: Synthetic polypeptide
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 179 - DNA, 747 bp, Artificial Sequence
  Description of Artificial Sequence: Synthetic polynucleotide
cagatccagctggtgcagtcgggagctgaagtgaaaaagccgggagcatcggtgaaggtgtcatgcaaagccagcggttacatcttcactaactacggtatgaactgggtgagacaagcgcctggccagagattggaatggatgggatggatcaatacctacaccggggaatcaacttacagcgccgacttcaagggacgcgtgaccatcacgctggacacctccgcgtccactgcctacatggagctctcgtcattgcggagcgaggacaccgccgtctactactgcgcacggtcaggagggtacgatccgatggactactggggacagggcactaccgtcaccgtgagctccggtggaggcggcagcggcggtggcggatcaggtggaggaggatcaggaggaggagggtccgatatcgtgcttactcagtcacccgattcgctggcagtctccctcggagaacgcgccaccatcaattgtcgcgcgtccgaatccgtcgacaactacggcaacacctttatgcactggtaccaacagaagcctggacaaccgccaaaactgctgatctaccgcgctagcaacctcgaatcgggcgtgccagataggttctcgggctcggggagccggacggattttactctgactatttcgtccctccaagcagaggacgtcgccgtgtattactgccagcaatcgaatgaggacccgccaactttcggacaggggaccaagctggagattaag

SEQ ID NO: 180 - DNA, 843 bp, Artificial Sequence
  Description of Artificial Sequence: Synthetic polynucleotide
atggccctccctgtcaccgccctgctgcttccgctggctcttctgctccacgccgctcggccccagatccagctggtgcagtcgggagctgaagtgaaaaagccgggagcatcggtgaaggtgtcatgcaaagccagcggttacatcttcactaactacggtatgaactgggtgagacaagcgcctggccagagattggaatggatgggatggatcaatacctacaccggggaatcaacttacagcgccgacttcaagggacgcgtgaccatcacgctggacacctccgcgtccactgcctacatggagctctcgtcattgcggagcgaggacaccgccgtctactactgcgcacggtcaggagggtacgatccgatggactactggggacagggcactaccgtcaccgtgagctccggtggaggcggcagcggcggtggcggatcaggtggaggaggatcaggaggaggagggtccgatatcgtgcttactcagtcacccgattcgctggcagtctccctcggagaacgcgccaccatcaattgtcgcgcgtccgaatccgtcgacaactacggcaacacctttatgcactggtaccaacagaagcctggacaaccgccaaaactgctgatctaccgcgctagcaacctcgaatcgggcgtgccagataggttctcgggctcggggagccggacggattttactctgactatttcgtccctccaagcagaggacgtcgccgtgtattactgccagcaatcgaatgaggacccgccaactttcggacaggggaccaagctggagattaagggctcgcaccaccatcaccatcatcatcaccac

SEQ ID NO: 181 - protein, 281 aa, Artificial Sequence
  Description of Artificial Sequence: Synthetic polypeptide
MALPVTALLLPLALLLHAARPQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGSHHHHHHHHH

SEQ ID NO: 182 - DNA, 1479 bp, Artificial Sequence
  Description of Artificial Sequence: Synthetic polynucleotide
atggccctccctgtcaccgccctgctgcttccgctggctcttctgctccacgccgctcggccccagatccagctggtgcagtcgggagctgaagtgaaaaagccgggagcatcggtgaaggtgtcatgcaaagccagcggttacatcttcactaactacggtatgaactgggtgagacaagcgcctggccagagattggaatggatgggatggatcaatacctacaccggggaatcaacttacagcgccgacttcaagggacgcgtgaccatcacgctggacacctccgcgtccactgcctacatggagctctcgtcattgcggagcgaggacaccgccgtctactactgcgcacggtcaggagggtacgatccgatggactactggggacagggcactaccgtcaccgtgagctccggtggaggcggcagcggcggtggcggatcaggtggaggaggatcaggaggaggagggtccgatatcgtgcttactcagtcacccgattcgctggcagtctccctcggagaacgcgccaccatcaattgtcgcgcgtccgaatccgtcgacaactacggcaacacctttatgcactggtaccaacagaagcctggacaaccgccaaaactgctgatctaccgcgctagcaacctcgaatcgggcgtgccagataggttctcgggctcggggagccggacggattttactctgactatttcgtccctccaagcagaggacgtcgccgtgtattactgccagcaatcgaatgaggacccgccaactttcggacaggggaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 183 - protein, 493 aa, Artificial Sequence
  Description of Artificial Sequence: Synthetic polypeptide
MALPVTALLLPLALLLHAARPQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 184 - protein, 249 aa, Artificial Sequence
  Description of Artificial Sequence: Synthetic polypeptide
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 185 - DNA, 747 bp, Artificial Sequence
  Description of Artificial Sequence: Synthetic polynucleotide
cagatccagctggtgcaatcgggagctgaagtgaagaagcccggagcttcagtcaaagtcagctgcaaggcgtcgggctatatcttcaccaactacgggatgaactgggtgcggcaggcccctggacaaagactggaatggatgggatggatcaacacttatactggcgagagcacgtactcagccgactttaagggacgggtgactatcaccctcgatacctccgcctccactgcgtacatggaactctcgtccttgcgctccgaggacactgccgtgtactactgcgccaggtcgggtggctacgatccgatggattactggggtcaaggaaccaccgtcactgtgtcgtccggcggaggcgggagcggaggtggtggttcgggaggaggagggtcaggcggaggaggcagcgaaatcgtgctgacccaaagcccggcaactctgtcactcagcccaggggagagggcaaccctgtcatgtcgggctagcgaatccgtggacaattacggaaacacgtttatgcactggtaccaacagaaaccaggacaggcgcctagacttctcatctaccgcgcgagcaatttggaatccggcatcccagcccgcttctccgggtcggggtcacgcaccgatttcactctgaccatttcctccctggaacccgaggacgtggcagtctactactgccagcagtcgaatgaggacccgccgaccttcggacagggcaccaagctggagattaag

SEQ ID NO: 186 - DNA, 843 bp, Artificial Sequence
  Description of Artificial Sequence: Synthetic polynucleotide
atggccctccctgtcaccgccctgctgcttccgctggctcttctgctccacgccgctcggccccagatccagctggtgcaatcgggagctgaagtgaagaagcccggagcttcagtcaaagtcagctgcaaggcgtcgggctatatcttcaccaactacgggatgaactgggtgcggcaggcccctggacaaagactggaatggatgggatggatcaacacttatactggcgagagcacgtactcagccgactttaagggacgggtgactatcaccctcgatacctccgcctccactgcgtacatggaactctcgtccttgcgctccgaggacactgccgtgtactactgcgccaggtcgggtggctacgatccgatggattactggggtcaaggaaccaccgtcactgtgtcgtccggcggaggcgggagcggaggtggtggttcgggaggaggagggtcaggcggaggaggcagcgaaatcgtgctgacccaaagcccggcaactctgtcactcagcccaggggagagggcaaccctgtcatgtcgggctagcgaatccgtggacaattacggaaacacgtttatgcactggtaccaacagaaaccaggacaggcgcctagacttctcatctaccgcgcgagcaatttggaatccggcatcccagcccgcttctccgggtcggggtcacgcaccgatttcactctgaccatttcctccctggaacccgaggacgtggcagtctactactgccagcagtcgaatgaggacccgccgaccttcggacagggcaccaagctggagattaagggctcgcaccaccatcaccatcatcatcaccac

SEQ ID NO: 187 - protein, 281 aa, Artificial Sequence
  Description of Artificial Sequence: Synthetic polypeptide
MALPVTALLLPLALLLHAARPQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGSHHHHHHHHH

SEQ ID NO: 188 - DNA, 1479 bp, Artificial Sequence
  Description of Artificial Sequence: Synthetic polynucleotide
atggccctccctgtcaccgccctgctgcttccgctggctcttctgctccacgccgctcggccccagatccagctggtgcaatcgggagctgaagtgaagaagcccggagcttcagtcaaagtcagctgcaaggcgtcgggctatatcttcaccaactacgggatgaactgggtgcggcaggcccctggacaaagactggaatggatgggatggatcaacacttatactggcgagagcacgtactcagccgactttaagggacgggtgactatcaccctcgatacctccgcctccactgcgtacatggaactctcgtccttgcgctccgaggacactgccgtgtactactgcgccaggtcgggtggctacgatccgatggattactggggtcaaggaaccaccgtcactgtgtcgtccggcggaggcgggagcggaggtggtggttcgggaggaggagggtcaggcggaggaggcagcgaaatcgtgctgacccaaagcccggcaactctgtcactcagcccaggggagagggcaaccctgtcatgtcgggctagcgaatccgtggacaattacggaaacacgtttatgcactggtaccaacagaaaccaggacaggcgcctagacttctcatctaccgcgcgagcaatttggaatccggcatcccagcccgcttctccgggtcggggtcacgcaccgatttcactctgaccatttcctccctggaacccgaggacgtggcagtctactactgccagcagtcgaatgaggacccgccgaccttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 189 - protein, 493 aa, Artificial Sequence
  Description of Artificial Sequence: Synthetic polypeptide
MALPVTALLLPLALLLHAARPQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 190 - DNA, 2003 bp, Artificial Sequence
  Description of Artificial Sequence: Synthetic polynucleotide
ggcagcggagagggcagaggaagtcttctaacatgcggtgacgtggaggagaatcccggccctagagccaccatggccctgcctgtgacagccctgctgctgcctctggctctgctgctgcatgccgctagacccggatccgacatcgtgctgacacagagccctgcttccctggccgtgtccctgggacagagagccacaatcagctgcagggccagcgagagcgtggacaactacggcaacaccttcatgcactggtatcagcagaagcccggccagccccccaagctgctgatctacagagccagcaacctggaaagcggcatccccgccagattttccggcagcggcagcagaaccgacttcaccctgaccatcaaccccgtggaagccgacgacgtggccacctactactgccagcagagcaacgaggacccccccacatttggagccggcaccaagctggaactgaagggcggaggcggatctggcggcggaggatcttctgggggaggctctcagattcagctggtgcagagcggcccagagctgaagaaacccggcgagacagtgaagatctcctgcaaggcctccggctacatcttcaccaattacggcatgaactgggtcaagcaggcccctggcaagagcttcaagtggatgggctggatcaacacctacaccggcgagagcacctacagcgccgacttcaagggcagattcgccttcagcctggaaaccagcgccagcaccgcctacctgcacatcaacgacctgaagaacgaggacaccgccacctatttctgcgccagaagcggcggctacgaccccatggattattggggccagggcaccagcgtgaccgtgtcctctgctagctccggaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgacagctcgctttcttgctgtccaatttctattaaaggttcctttgttccctaagtccaactactaaactgggggatattatgaagggccttgagcatctggattctgcctaataaaaaacatttattttcattgctgcgtcgagagctcgctttcttgctgtccaatttctattaaaggttcctttgttccctaagtccaactactaaactgggggatattatgaagggccttgagcatctggattctgcctaataaaaaacatttattttcattgctgcctcgacgaattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 191 - protein, 494 aa, Artificial Sequence
  Description of Artificial Sequence: Synthetic polypeptide
MALPVTALLLPLALLLHAARPGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSSGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSASSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 192 - DNA, 2019 bp, Artificial Sequence
  Description of Artificial Sequence: Synthetic polynucleotide
atggccctgcctgtgacagccctgctgctgcctctggctctgctgctgcacgccgctagacctggatcccaggtgcagctgcagcagcctggcgctgaactcgtgcggccaggcgcttctgtgaagctgagctgtaaagccagcggctacaccttcaccagctactggatgaactgggtcaagcagcggcccgaccagggcctggagtggatcggcagaatcgacccctacgacagcgagacacactacaaccagaagttcaaggacaaggccatcctgaccgtggacaagagcagcagcaccgcctacatgcagctgtccagcctgaccagcgaggacagcgccgtgtactactgcgccaggggcaactgggacgactattggggccagggcaccaccctgacagtgtctagcggaggcggaggatctggcggcggaggaagttctggcggaggctccgacgtgcagatcacccagagccctagctacctggccgcctctcctggcgagacaatcaccatcaactgccgggccagcaagagcatctccaaggacctggcctggtatcaggaaaagcccggcaagaccaacaagctgctgatctacagcggcagcaccctgcagagcggcatccccagcagattttccggcagcggctccggcaccgacttcaccctgaccatcagctccctggaacccgaggactttgccatgtactattgccagcagcacaacaagtacccttacaccttcggcggaggcaccaagctggaaatcaaggccagctccggagagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatggatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 193 - protein, 673 aa, Artificial Sequence
  Description of Artificial Sequence: Synthetic polypeptide
MALPVTALLLPLALLLHAARPGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSSGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKASSGESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 194 - DNA, 1461 bp, Artificial Sequence
  Description of Artificial Sequence: Synthetic polynucleotide
atggccctccctgtcaccgccctgctgcttccgctggctcttctgctccacgccgctcggccccaagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 195 - protein, 487 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 196 - protein, 264 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 197 - protein, 121 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSS

SEQ ID NO: 198 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 199 - DNA, 1461 bp, Artificial Sequence
  Description of Artificial Sequence: Synthetic polynucleotide
atggccctccctgtcaccgccctgctgcttccgctggctcttctgctccacgccgctcggccccaagtccaactcgttcaatccggcgcagaagtcaagaagccaggagcatcagtgaaagtgtcctgcaaagcctcaggctacatcttcacgggatactacatccactgggtgcgccaggctccgggccagggccttgagtggatgggctggatcaaccctaactctgggggaaccaactacgctcagaagttccaggggagggtcactatgactcgcgatacctccatctccactgcgtacatggaactctcgggactgagatccgacgatcctgccgtgtactactgcgcccgggacatgaacatcttggcgaccgtgccgtttgacatttggggacagggcaccctcgtcactgtgtcgagcggtggaggaggctcggggggtggcggatcaggagggggaggaagcgacatccagctgactcagagcccatcgtcgttgtccgcgtcggtgggggatagagtgaccattacttgccgcgccagccagagcatctcatcatatctgaattggtaccagcagaagcccggaaaggccccaaaactgctgatctacgctgcaagcagcctccaatcgggagtgccgtcacggttctccgggtccggttcgggaactgactttaccctgaccgtgaattcgctgcaaccggaggatttcgccacgtactactgtcagcaaggagactccgtgccgctgaccttcggtggaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 200 - protein, 487 aa, Artificial Sequence
  Description of Artificial Sequence: Synthetic polypeptide
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 201 - protein, 264 aa, Artificial Sequence
  Description of Artificial Sequence: Synthetic polypeptide
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 202 - protein, 121 aa, Artificial Sequence
  Description of Artificial Sequence: Synthetic polypeptide
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSS

SEQ ID NO: 203 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 204 - DNA, 1467 bp, Artificial Sequence
  Description of Artificial Sequence: Synthetic polynucleotide
atggccctccctgtcaccgccctgctgcttccgctggctcttctgctccacgccgctcggccccaagtccaactccaacagtcaggcgcagaagtgaaaaagagcggtgcatcggtgaaagtgtcatgcaaagcctcgggctacaccttcactgactactatatgcactggctgcggcaggcaccgggacagggacttgagtggatgggatggatcaacccgaattcaggggacactaactacgcgcagaagttccaggggagagtgaccctgacgagggacacctcaatttcgaccgtctacatggaattgtcgcgcctgagatcggacgatactgctgtgtactactgtgcccgcgacatgaacatcctcgcgactgtgccttttgatatctggggacaggggactatggtcaccgtttcctccgcttccggtggcggaggctcgggaggccgggcctccggtggaggaggcagcgacatccagatgactcagagcccttcctcgctgagcgcctcagtgggagatcgcgtgaccatcacttgccgggccagccagtccatttcgtcctacctcaattggtaccagcagaagccgggaaaggcgcccaagctcttgatctacgctgcgagctccctgcaaagcggggtgccgagccgattctcgggttccggctcgggaaccgacttcactctgaccatctcatccctgcaaccagaggactttgccacctactactgccaacaaggagattctgtcccactgacgttcggcggaggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 205 - protein, 336 aa, Artificial Sequence
  Description of Artificial Sequence: Synthetic polypeptide
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 206 - protein, 266 aa, Artificial Sequence
  Description of Artificial Sequence: Synthetic polypeptide
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 207 - protein, 121 aa, Artificial Sequence
  Description of Artificial Sequence: Synthetic polypeptide
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSS

SEQ ID NO: 208 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 209 - DNA, 1461 bp, Artificial Sequence
  Description of Artificial Sequence: Synthetic polynucleotide
atggccctccctgtcaccgccctgctgcttccgctggctcttctgctccacgccgctcggccccaagtccaactcgtccagtcaggagcggaagtcaagaagcccggagcgtcagtcaaagtgtcatgcaaagcctcgggctacactttcactgggtactacatgcactgggtgcgccaggctccaggacagggactggaatggatgggatggatcaacccgaactccggtggcaccaattacgcccagaagttccaggggagggtgaccatgactcgcgacacgtcgatcagcaccgcatacatggagctgtcaagactccggtccgacgatactgccgtgtactactgcgcacgggacatgaacattctggccaccgtgccttttgacatctggggtcagggaactatggttaccgtgtcctctggtggaggcggctccggcggggggggaagcggaggcggtggaagcgacattcagatgacccagtcgccttcatccctttcggcgagcgtgggagatcgcgtcactatcacttgtcgggcctcgcagtccatctccacctacctcaattggtaccagcagaagccaggaaaagcaccgaatctgctgatctacgccgcgttttccttgcaatcgggagtgccaagcagattcagcggatcgggatcaggcactgatttcaccctcaccatcaactcgctgcaaccggaggatttcgctacgtactattgccaacaaggagacagcgtgccgctcaccttcggcggagggactaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 210 - protein, 487 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - protein, 264 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 212 - protein, 121 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSS

SEQ ID NO: 213 - protein, 107 aa, Artificial Sequence
  Description of Artificial Sequence: Synthetic polypeptide
DIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 214 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 215 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 216 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 217 - protein, 115 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 218 - protein, 107 aa, Artificial Sequence
  Description of Artificial Sequence: Synthetic polypeptide
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 219 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 220 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 221 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 222 - protein, 115 aa, Artificial Sequence; identical to SEQ ID NO: 217
  Description of Artificial Sequence: Synthetic polypeptide

SEQ ID NO: 223 - protein, 107 aa, Artificial Sequence
  Description of Artificial Sequence: Synthetic polypeptide
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 224 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 225 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 226 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 227 - protein, 115 aa, Artificial Sequence; identical to SEQ ID NO: 217
  Description of Artificial Sequence: Synthetic polypeptide

SEQ ID NO: 228 - protein, 107 aa, Artificial Sequence
  Description of Artificial Sequence: Synthetic polypeptide
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 229 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 230 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 231 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 232 - protein, 115 aa, Artificial Sequence; identical to SEQ ID NO: 217
  Description of Artificial Sequence: Synthetic polypeptide

SEQ ID NO: 233 - protein, 107 aa, Artificial Sequence
  Description of Artificial Sequence: Synthetic polypeptide
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 234 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 235 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 236 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 237 - protein, 115 aa, Artificial Sequence; identical to SEQ ID NO: 217
  Description of Artificial Sequence: Synthetic polypeptide

SEQ ID NO: 238 - protein, 107 aa, Artificial Sequence; identical to SEQ ID NO: 218
  Description of Artificial Sequence: Synthetic polypeptide

SEQ ID NO: 239 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 240 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 241 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 242 - protein, 115 aa, Artificial Sequence; identical to SEQ ID NO: 217
  Description of Artificial Sequence: Synthetic polypeptide

SEQ ID NO: 243 - protein, 107 aa, Artificial Sequence; identical to SEQ ID NO: 223
  Description of Artificial Sequence: Synthetic polypeptide

SEQ ID NO: 244 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 245 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 246 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 247 - protein, 115 aa, Artificial Sequence; identical to SEQ ID NO: 217
  Description of Artificial Sequence: Synthetic polypeptide

SEQ ID NO: 248 - protein, 107 aa, Artificial Sequence; identical to SEQ ID NO: 228
  Description of Artificial Sequence: Synthetic polypeptide

SEQ ID NO: 249 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 250 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 251 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 252 - protein, 115 aa, Artificial Sequence; identical to SEQ ID NO: 217
  Description of Artificial Sequence: Synthetic polypeptide

SEQ ID NO: 253 - protein, 107 aa, Artificial Sequence; identical to SEQ ID NO: 233
  Description of Artificial Sequence: Synthetic polypeptide

SEQ ID NO: 254 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 255 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 256 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 257 - protein, 115 aa, Artificial Sequence
  Description of Artificial Sequence: Synthetic polypeptide
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 258 - protein, 107 aa, Artificial Sequence; identical to SEQ ID NO: 218
  Description of Artificial Sequence: Synthetic polypeptide

SEQ ID NO: 259 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 260 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 261 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 262 - protein, 115 aa, Artificial Sequence; identical to SEQ ID NO: 257
  Description of Artificial Sequence: Synthetic polypeptide

SEQ ID NO: 263 - protein, 107 aa, Artificial Sequence; identical to SEQ ID NO: 223
  Description of Artificial Sequence: Synthetic polypeptide

SEQ ID NO: 264 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 265 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 266 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 267 - protein, 115 aa, Artificial Sequence; identical to SEQ ID NO: 257
  Description of Artificial Sequence: Synthetic polypeptide

SEQ ID NO: 268 - protein, 107 aa, Artificial Sequence; identical to SEQ ID NO: 228
  Description of Artificial Sequence: Synthetic polypeptide

SEQ ID NO: 269 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 270 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 272 - protein, 115 aa, Artificial Sequence; identical to SEQ ID NO: 257
  Description of Artificial Sequence: Synthetic polypeptide

SEQ ID NO: 273 - protein, 107 aa, Artificial Sequence; identical to SEQ ID NO: 233
  Description of Artificial Sequence: Synthetic polypeptide

SEQ ID NO: 274 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 275 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 276 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 277 - protein, 115 aa, Artificial Sequence; identical to SEQ ID NO: 257
  Description of Artificial Sequence: Synthetic polypeptide

SEQ ID NO: 278 - protein, 107 aa, Artificial Sequence; identical to SEQ ID NO: 218
  Description of Artificial Sequence: Synthetic polypeptide

SEQ ID NO: 279 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 280 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 281 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 282 - protein, 115 aa, Artificial Sequence; identical to SEQ ID NO: 257
  Description of Artificial Sequence: Synthetic polypeptide

SEQ ID NO: 283 - protein, 107 aa, Artificial Sequence; identical to SEQ ID NO: 223
  Description of Artificial Sequence: Synthetic polypeptide

SEQ ID NO: 284 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 285 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 286 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 287 - protein, 115 aa, Artificial Sequence; identical to SEQ ID NO: 257
  Description of Artificial Sequence: Synthetic polypeptide

SEQ ID NO: 288 - protein, 107 aa, Artificial Sequence; identical to SEQ ID NO: 228
  Description of Artificial Sequence: Synthetic polypeptide

SEQ ID NO: 289 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 290 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 291 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 292 - protein, 115 aa, Artificial Sequence; identical to SEQ ID NO: 257
  Description of Artificial Sequence: Synthetic polypeptide

SEQ ID NO: 293 - protein, 107 aa, Artificial Sequence; identical to SEQ ID NO: 233
  Description of Artificial Sequence: Synthetic polypeptide

SEQ ID NO: 294 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 295 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 297 - protein, 115 aa, Artificial Sequence
  Description of Artificial Sequence: Synthetic polypeptide
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 298 - protein, 107 aa, Artificial Sequence; identical to SEQ ID NO: 218
  Description of Artificial Sequence: Synthetic polypeptide

SEQ ID NO: 299 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 300 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 301 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 302 - protein, 115 aa, Artificial Sequence; identical to SEQ ID NO: 297
  Description of Artificial Sequence: Synthetic polypeptide

SEQ ID NO: 303 - protein, 107 aa, Artificial Sequence; identical to SEQ ID NO: 223
  Description of Artificial Sequence: Synthetic polypeptide

SEQ ID NO: 304 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 305 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 306 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 307 - protein, 115 aa, Artificial Sequence; identical to SEQ ID NO: 297
  Description of Artificial Sequence: Synthetic polypeptide

SEQ ID NO: 308 - protein, 107 aa, Artificial Sequence; identical to SEQ ID NO: 228
  Description of Artificial Sequence: Synthetic polypeptide

SEQ ID NO: 309 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 310 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 311 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 312 - protein, 115 aa, Artificial Sequence; identical to SEQ ID NO: 297
  Description of Artificial Sequence: Synthetic polypeptide

SEQ ID NO: 313 - protein, 107 aa, Artificial Sequence; identical to SEQ ID NO: 233
  Description of Artificial Sequence: Synthetic polypeptide

SEQ ID NO: 314 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 315 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 316 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 317 - protein, 115 aa, Artificial Sequence; identical to SEQ ID NO: 297
  Description of Artificial Sequence: Synthetic polypeptide

SEQ ID NO: 318 - protein, 107 aa, Artificial Sequence; identical to SEQ ID NO: 218
  Description of Artificial Sequence: Synthetic polypeptide

SEQ ID NO: 319 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 320 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 321 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 322 - protein, 115 aa, Artificial Sequence; identical to SEQ ID NO: 297
  Description of Artificial Sequence: Synthetic polypeptide

SEQ ID NO: 323 - protein, 107 aa, Artificial Sequence; identical to SEQ ID NO: 223
  Description of Artificial Sequence: Synthetic polypeptide

SEQ ID NO: 324 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 325 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 326 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 327 - protein, 115 aa, Artificial Sequence; identical to SEQ ID NO: 297
  Description of Artificial Sequence: Synthetic polypeptide

SEQ ID NO: 328 - protein, 107 aa, Artificial Sequence; identical to SEQ ID NO: 228
  Description of Artificial Sequence: Synthetic polypeptide

SEQ ID NO: 329 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 330 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 332 - protein, 115 aa, Artificial Sequence; identical to SEQ ID NO: 297
  Description of Artificial Sequence: Synthetic polypeptide

SEQ ID NO: 333 - protein, 107 aa, Artificial Sequence; identical to SEQ ID NO: 233
  Description of Artificial Sequence: Synthetic polypeptide

SEQ ID NO: 334 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 335 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 336 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 337 - protein, 115 aa, Artificial Sequence
  Description of Artificial Sequence: Synthetic polypeptide
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 338 - protein, 107 aa, Artificial Sequence; identical to SEQ ID NO: 218
  Description of Artificial Sequence: Synthetic polypeptide

SEQ ID NO: 339 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 340 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 341 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 342 - protein, 115 aa, Artificial Sequence; identical to SEQ ID NO: 337
  Description of Artificial Sequence: Synthetic polypeptide

SEQ ID NO: 343 - protein, 107 aa, Artificial Sequence; identical to SEQ ID NO: 223
  Description of Artificial Sequence: Synthetic polypeptide

SEQ ID NO: 344 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 345 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 346 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 347 - protein, 115 aa, Artificial Sequence; identical to SEQ ID NO: 337
  Description of Artificial Sequence: Synthetic polypeptide

SEQ ID NO: 348 - protein, 107 aa, Artificial Sequence; identical to SEQ ID NO: 228
  Description of Artificial Sequence: Synthetic polypeptide

SEQ ID NO: 349 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 350 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 351 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 352 - protein, 115 aa, Artificial Sequence; identical to SEQ ID NO: 337
  Description of Artificial Sequence: Synthetic polypeptide

SEQ ID NO: 353 - protein, 107 aa, Artificial Sequence; identical to SEQ ID NO: 233
  Description of Artificial Sequence: Synthetic polypeptide

SEQ ID NO: 354 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 355 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 356 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 357 - protein, 115 aa, Artificial Sequence; identical to SEQ ID NO: 337
  Description of Artificial Sequence: Synthetic polypeptide

SEQ ID NO: 358 - protein, 107 aa, Artificial Sequence; identical to SEQ ID NO: 218
  Description of Artificial Sequence: Synthetic polypeptide

SEQ ID NO: 359 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 360 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 361 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 362 - protein, 115 aa, Artificial Sequence; identical to SEQ ID NO: 337
  Description of Artificial Sequence: Synthetic polypeptide

SEQ ID NO: 363 - protein, 107 aa, Artificial Sequence; identical to SEQ ID NO: 223
  Description of Artificial Sequence: Synthetic polypeptide

SEQ ID NO: 364 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 365 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 366 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 367 - protein, 115 aa, Artificial Sequence; identical to SEQ ID NO: 337
  Description of Artificial Sequence: Synthetic polypeptide

SEQ ID NO: 368 - protein, 107 aa, Artificial Sequence; identical to SEQ ID NO: 228
  Description of Artificial Sequence: Synthetic polypeptide

SEQ ID NO: 369 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 370 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 371 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 372 - protein, 115 aa, Artificial Sequence; identical to SEQ ID NO: 337
  Description of Artificial Sequence: Synthetic polypeptide

SEQ ID NO: 373 - protein, 107 aa, Artificial Sequence; identical to SEQ ID NO: 233
  Description of Artificial Sequence: Synthetic polypeptide

SEQ ID NO: 374 - DNA, 729 bp, Artificial Sequence
  Description of Artificial Sequence: Synthetic polynucleotide
caagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaag

SEQ ID NO: 375 - protein, 243 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 376 - DNA, 1760 bp, Artificial Sequence
  Description of Artificial Sequence: Synthetic polynucleotide
atggccctccctgtcaccgccctgctgcttccgctggctcttctgctccacgccgctcggccccaagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcttgccggttcccagaggaggaggaaggcggctgcgaactgcgcgtgaaattcagccgcagcgcagacgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaagtcgacagctcgctttcttgctgtccaatttctattaaaggttcctttgttccctaagtccaactactaaactgggggatattatgaagggccttgagcatctggattctgcctaataaaaaacatttattttcattgctgcgtcgagagctcgctttcttgctgtccaatttctattaaaggttcctttgttccctaagtccaactactaaactgggggatattatgaagggccttgagcatctggattctgcctaataaaaaacatttattttcattgctgcctcgacgaattc

SEQ ID NO: 377 - DNA, 729 bp, Artificial Sequence
  Description of Artificial Sequence: Synthetic polynucleotide
caagtccaactcgttcaatccggcgcagaagtcaagaagccaggagcatcagtgaaagtgtcctgcaaagcctcaggctacatcttcacgggatactacatccactgggtgcgccaggctccgggccagggccttgagtggatgggctggatcaaccctaactctgggggaaccaactacgctcagaagttccaggggagggtcactatgactcgcgatacctccatctccactgcgtacatggaactctcgggactgagatccgacgatcctgccgtgtactactgcgcccgggacatgaacatcttggcgaccgtgccgtttgacatttggggacagggcaccctcgtcactgtgtcgagcggtggaggaggctcggggggtggcggatcaggagggggaggaagcgacatccagctgactcagagcccatcgtcgttgtccgcgtcggtgggggatagagtgaccattacttgccgcgccagccagagcatctcatcatatctgaattggtaccagcagaagcccggaaaggccccaaaactgctgatctacgctgcaagcagcctccaatcgggagtgccgtcacggttctccgggtccggttcgggaactgactttaccctgaccgtgaattcgctgcaaccggaggatttcgccacgtactactgtcagcaaggagactccgtgccgctgaccttcggtggaggcaccaaggtcgaaatcaag

SEQ ID NO: 378 - protein, 243 aa, Artificial Sequence
  Description of Artificial Sequence: Synthetic polypeptide
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 379 - DNA, 735 bp, Artificial Sequence
  Description of Artificial Sequence: Synthetic polynucleotide
caagtccaactccaacagtcaggcgcagaagtgaaaaagagcggtgcatcggtgaaagtgtcatgcaaagcctcgggctacaccttcactgactactatatgcactggctgcggcaggcaccgggacagggacttgagtggatgggatggatcaacccgaattcaggggacactaactacgcgcagaagttccaggggagagtgaccctgacgagggacacctcaatttcgaccgtctacatggaattgtcgcgcctgagatcggacgatactgctgtgtactactgtgcccgcgacatgaacatcctcgcgactgtgccttttgatatctggggacaggggactatggtcaccgtttcctccgcttccggtggcggaggctcgggaggccgggcctccggtggaggaggcagcgacatccagatgactcagagcccttcctcgctgagcgcctcagtgggagatcgcgtgaccatcacttgccgggccagccagtccatttcgtcctacctcaattggtaccagcagaagccgggaaaggcgcccaagctcttgatctacgctgcgagctccctgcaaagcggggtgccgagccgattctcgggttccggctcgggaaccgacttcactctgaccatctcatccctgcaaccagaggactttgccacctactactgccaacaaggagattctgtcccactgacgttcggcggaggaaccaaggtcgaaatcaag

SEQ ID NO: 380 - protein, 245 aa, Artificial Sequence
  Description of Artificial Sequence: Synthetic polypeptide
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 381 - protein, 243 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 382 - protein, 242 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 383 - protein, 242 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 384 - protein, 242 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 385 - protein, 242 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 386 - protein, 242 aa, Artificial Sequence
  Description of Artificial Sequence: Synthetic polypeptide
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 387 - protein, 242 aa, Artificial Sequence
  Description of Artificial Sequence: Synthetic polypeptide
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 388 - protein, 242 aa, Artificial Sequence
  Description of Artificial Sequence: Synthetic polypeptide
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 389 - protein, 242 aa, Artificial Sequence
  Description of Artificial Sequence: Synthetic polypeptide
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 390 - protein, 242 aa, Artificial Sequence
  Description of Artificial Sequence: Synthetic polypeptide
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 391 - protein, 242 aa, Artificial Sequence
  Description of Artificial Sequence: Synthetic polypeptide
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 392 - protein, 242 aa, Artificial Sequence
  Description of Artificial Sequence: Synthetic polypeptide
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 393 - protein, 242 aa, Artificial Sequence
  Description of Artificial Sequence: Synthetic polypeptide
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 394 - protein, 242 aa, Artificial Sequence
  Description of Artificial Sequence: Synthetic polypeptide
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 395 - protein, 242 aa, Artificial Sequence
  Description of Artificial Sequence: Synthetic polypeptide
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 396 - protein, 242 aa, Artificial Sequence
  Description of Artificial Sequence: Synthetic polypeptide
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 397 - protein, 242 aa, Artificial Sequence
  Description of Artificial Sequence: Synthetic polypeptide
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 398 - protein, 242 aa, Artificial Sequence
  Description of Artificial Sequence: Synthetic polypeptide
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 399 - protein, 242 aa, Artificial Sequence
  Description of Artificial Sequence: Synthetic polypeptide
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 400 - protein, 242 aa, Artificial Sequence
  Description of Artificial Sequence: Synthetic polypeptide
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 401 - protein, 242 aa, Artificial Sequence
  Description of Artificial Sequence: Synthetic polypeptide
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 402 - protein, 242 aa, Artificial Sequence
  Description of Artificial Sequence: Synthetic polypeptide
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 403 - protein, 242 aa, Artificial Sequence
  Description of Artificial Sequence: Synthetic polypeptide
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 404 - protein, 242 aa, Artificial Sequence
  Description of Artificial Sequence: Synthetic polypeptide
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 405 - protein, 242 aa, Artificial Sequence
  Description of Artificial Sequence: Synthetic polypeptide
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 406 - protein, 242 aa, Artificial Sequence
  Description of Artificial Sequence: Synthetic polypeptide
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 407 - protein, 242 aa, Artificial Sequence
  Description of Artificial Sequence: Synthetic polypeptide
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 408 - protein, 242 aa, Artificial Sequence
  Description of Artificial Sequence: Synthetic polypeptide
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 409 - protein, 242 aa, Artificial Sequence
  Description of Artificial Sequence: Synthetic polypeptide
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 410 - protein, 242 aa, Artificial Sequence
  Description of Artificial Sequence: Synthetic polypeptide
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 411 - protein, 242 aa, Artificial Sequence
  Description of Artificial Sequence: Synthetic polypeptide
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 412 - protein, 242 aa, Artificial Sequence
  Description of Artificial Sequence: Synthetic polypeptide
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 413 - protein, 242 aa, Artificial Sequence
  Description of Artificial Sequence: Synthetic polypeptide
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 414 - protein, 491 aa, Artificial Sequence
  Description of Artificial Sequence: Synthetic polypeptide
MALPVTALLLPLALLLHAARPGSEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 415 - protein, 246 aa, Artificial Sequence
  Description of Artificial Sequence: Synthetic polypeptide
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 416 - DNA, 738 bp, Artificial Sequence
  Description of Artificial Sequence: Synthetic polynucleotide
gaaatccagctggtccaatcgggagctgaggtcaagaagccgggagccaccgtcaagatctcatgcaaggggtcgggattcaacatcgaggactactacattcactgggtgcagcaagctccgggaaaaggcctggaatggatgggcagaatcgacccagaaaacgacgaaactaagtacggaccgattttccaaggaagagtgactatcaccgccgatacttcaaccaataccgtctacatggaactgagctcgctccggtccgaagatactgcagtgtattactgtgcctttcgcggaggggtgtactggggccaaggaactactgtcactgtctcgtcaggaggcggagggtcgggaggaggcgggagcggaggcggtggctcgggtggcggaggaagcgacgtggtgatgacccagtccccggactccctcgccgtgagcctcggagagagggcgactatcaattgcaagtcgtcccagtcacttctggattccgatggtaaaacgtacctcaactggctgcagcaaaagccagggcagccacccaaacggttgatctcccttgtgtccaaactggatagcggagtgcctgaccgcttctcgggttccggtagcgggaccgacttcaccctgacgatcagctcactgcaggcggaggacgtggcagtgtactactgctggcagggaacccacttccctggcacctttggaggtggcaccaaggtggagatcaag

SEQ ID NO: 417 - DNA, 831 bp, Artificial Sequence
  Description of Artificial Sequence: Synthetic polynucleotide
atggccctccctgtcaccgccctgctgcttccgctggctcttctgctccacgccgctcggcccgaaatccagctggtccaatcgggagctgaggtcaagaagccgggagccaccgtcaagatctcatgcaaggggtcgggattcaacatcgaggactactacattcactgggtgcagcaagctccgggaaaaggcctggaatggatgggcagaatcgacccagaaaacgacgaaactaagtacggaccgattttccaaggaagagtgactatcaccgccgatacttcaaccaataccgtctacatggaactgagctcgctccggtccgaagatactgcagtgtattactgtgcctttcgcggaggggtgtactggggccaaggaactactgtcactgtctcgtcaggaggcggagggtcgggaggaggcgggagcggaggcggtggctcgggtggcggaggaagcgacgtggtgatgacccagtccccggactccctcgccgtgagcctcggagagagggcgactatcaattgcaagtcgtcccagtcacttctggattccgatggtaaaacgtacctcaactggctgcagcaaaagccagggcagccacccaaacggttgatctcccttgtgtccaaactggatagcggagtgcctgaccgcttctcgggttccggtagcgggaccgacttcaccctgacgatcagctcactgcaggcggaggacgtggcagtgtactactgctggcagggaacccacttccctggcacctttggaggtggcaccaaggtggagatcaagggatcgcaccaccatcaccatcatcatcac

SEQ ID NO: 418 - protein, 277 aa, Artificial Sequence
  Description of Artificial Sequence: Synthetic polypeptide
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHH

SEQ ID NO: 419 - DNA, 1470 bp, Artificial Sequence
  Description of Artificial Sequence: Synthetic polynucleotide
atggccctccctgtcaccgccctgctgcttccgctggctcttctgctccacgccgctcggcccgagatccagctggtgcagtcgggagctgaagtcaaaaagcctggcgcaaccgtcaagatctcgtgcaaaggatcagggttcaacatcgaggactactacatccattgggtgcaacaggcacccggaaaaggcctggagtggatggggaggattgacccagaaaatgacgaaaccaagtacggaccgatcttccaaggacgggtgaccatcacggctgacacttccactaacaccgtctacatggaactctcgagccttcgctcggaagataccgcggtgtactactgcgcctttagaggtggagtctactggggacaagggactaccgtcaccgtgtcgtcaggtggcggaggatcaggcggaggcggctccggtggaggaggaagcggaggaggtggctccgacgtggtgatgacgcagtcaccggactccttggcggtgagcctgggtgaacgcgccactatcaactgcaagagctcccagagcttgctggactccgatggaaagacttatctcaattggctgcaacagaagcctggccagccgccaaagagactcatctcactggtgagcaagctggatagcggagtgccagatcggttttcgggatcgggctcaggcaccgacttcaccctgactatttcctccctccaagccgaggatgtggccgtctactactgttggcaggggactcacttcccggggaccttcggtggaggcactaaggtggagatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 420 - protein, 490 aa, Artificial Sequence
  Description of Artificial Sequence: Synthetic polypeptide
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 421 - protein, 246 aa, Artificial Sequence
  Description of Artificial Sequence: Synthetic polypeptide
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 422 - DNA, 738 bp, Artificial Sequence
  Description of Artificial Sequence: Synthetic polynucleotide
gatgtcgtgatgacccagtccccagactccctcgcagtgtccttgggagaacgggccaccatcaactgcaaatcgagccagtcactgctggactcagacggaaagacctacctcaactggctgcagcagaagcctggccagccaccgaagcgcctgatctccctggtgtccaagctggactcgggcgtcccggacaggtttagcggtagcggctcgggaaccgacttcactctgaccattagctcgctccaagctgaagatgtggcggtctactactgctggcaggggacccacttccccgggacctttggcggaggaactaaagtcgaaatcaaaggaggaggcggatcaggtggaggaggcagcggaggaggagggagcggcggtggcggctccgaaattcaacttgtgcaatccggtgccgaggtgaagaaacctggtgccactgtcaagatctcgtgtaagggatcgggattcaatatcgaggactactacatccactgggtgcaacaggcgccaggaaagggattggagtggatgggtcgcatcgacccggaaaacgatgagactaagtacggaccgatcttccaaggccgggtcacgatcactgcggatacctccactaataccgtgtatatggagctctcgtcactgagaagcgaagatacggccgtgtactactgcgcattcagaggaggtgtgtactggggccagggaactactgtgaccgtgtcgtcg

SEQ ID NO: 423 - DNA, 831 bp, Artificial Sequence
  Description of Artificial Sequence: Synthetic polynucleotide
atggccctccctgtcaccgccctgctgcttccgctggctcttctgctccacgccgctcggcccgatgtcgtgatgacccagtccccagactccctcgcagtgtccttgggagaacgggccaccatcaactgcaaatcgagccagtcactgctggactcagacggaaagacctacctcaactggctgcagcagaagcctggccagccaccgaagcgcctgatctccctggtgtccaagctggactcgggcgtcccggacaggtttagcggtagcggctcgggaaccgacttcactctgaccattagctcgctccaagctgaagatgtggcggtctactactgctggcaggggacccacttccccgggacctttggcggaggaactaaagtcgaaatcaaaggaggaggcggatcaggtggaggaggcagcggaggaggagggagcggcggtggcggctccgaaattcaacttgtgcaatccggtgccgaggtgaagaaacctggtgccactgtcaagatctcgtgtaagggatcgggattcaatatcgaggactactacatccactgggtgcaacaggcgccaggaaagggattggagtggatgggtcgcatcgacccggaaaacgatgagactaagtacggaccgatcttccaaggccgggtcacgatcactgcggatacctccactaataccgtgtatatggagctctcgtcactgagaagcgaagatacggccgtgtactactgcgcattcagaggaggtgtgtactggggccagggaactactgtgaccgtgtcgtcggggtcacatcaccaccatcatcatcaccac

SEQ ID NO: 424 - protein, 277 aa, Artificial Sequence
  Description of Artificial Sequence: Synthetic polypeptide
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 425 - DNA, 1470 bp, Artificial Sequence
  Description of Artificial Sequence: Synthetic polynucleotide
atggccctccctgtcaccgccctgctgcttccgctggctcttctgctccacgccgctcggcccgacgtggtcatgactcaaagcccagattccttggctgtctcccttggagaaagagcaacgatcaattgcaaaagctcgcagtccctgttggactccgatggaaaaacctacctcaactggctgcagcagaagccgggacaaccaccaaagcggctgatttccctcgtgtccaagctggacagcggcgtgccggatcgcttctcgggcagcggctcgggaaccgattttactctcactatttcgtcactgcaagcggaggacgtggcggtgtattactgctggcagggcactcacttcccgggtacttttggtggaggtaccaaagtcgaaatcaagggtggaggcgggagcggaggaggcgggtcgggaggaggaggatcgggtggcggaggctcagaaatccagctggtgcagtcaggtgccgaagtgaagaagcctggggccacggtgaagatctcgtgcaaggggagcggattcaacatcgaggattactacatccattgggtgcaacaggcccctggcaaagggctggaatggatgggaaggatcgaccccgagaatgacgagactaagtacggcccgatcttccaaggacgggtgaccatcactgcagacacttcaaccaacaccgtctacatggaactctcctcgctgcgctccgaggacaccgccgtgtactactgtgctttcagaggaggagtctactggggacagggaacgaccgtgaccgtcagctcaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 426 - protein, 490 aa, Artificial Sequence
  Description of Artificial Sequence: Synthetic polypeptide
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 427 - protein, 246 aa, Artificial Sequence
  Description of Artificial Sequence: Synthetic polypeptide
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 428 - DNA, 738 bp, Artificial Sequence
  Description of Artificial Sequence: Synthetic polynucleotide
gagattcagctggtccaaagcggcgcagaagtgaaaaagccaggggaatcgttgcgcatcagctgtaaaggttccggcttcaacatcgaggactattacatccattgggtgcggcagatgccaggaaaggggctggaatggatgggacggattgacccggagaacgacgaaaccaagtacggaccgatctttcaaggacacgtgactatctccgccgacaccagcatcaatacggtgtacctccaatggtcctcactcaaggcctcggataccgcgatgtactactgcgcgttcagaggaggcgtctactggggacaagggactactgtgactgtctcatcaggaggtggaggaagcggaggaggtggctcgggcggaggtggatcgggaggaggagggtccgatgtggtgatgacccagtccccactgtcgctcccggtgaccctcggacagcctgctagcatctcgtgcaaatcctcgcaatccctgctggactcggacggaaaaacgtacctcaattggctgcagcagcgccctggccagagcccgagaaggcttatctcgctggtgtcaaagctggatagcggtgtgcccgaccggttcagcggctcagggtcaggaaccgatttcaccttgaagatctcccgcgtggaagccgaagatgtcggagtctactactgctggcagggtactcacttcccggggacctttggtggcggcactaaggtcgagattaag

SEQ ID NO: 429 - DNA, 831 bp, Artificial Sequence
  Description of Artificial Sequence: Synthetic polynucleotide
atggccctccctgtcaccgccctgctgcttccgctggctcttctgctccacgccgctcggcccgagattcagctggtccaaagcggcgcagaagtgaaaaagccaggggaatcgttgcgcatcagctgtaaaggttccggcttcaacatcgaggactattacatccattgggtgcggcagatgccaggaaaggggctggaatggatgggacggattgacccggagaacgacgaaaccaagtacggaccgatctttcaaggacacgtgactatctccgccgacaccagcatcaatacggtgtacctccaatggtcctcactcaaggcctcggataccgcgatgtactactgcgcgttcagaggaggcgtctactggggacaagggactactgtgactgtctcatcaggaggtggaggaagcggaggaggtggctcgggcggaggtggatcgggaggaggagggtccgatgtggtgatgacccagtccccactgtcgctcccggtgaccctcggacagcctgctagcatctcgtgcaaatcctcgcaatccctgctggactcggacggaaaaacgtacctcaattggctgcagcagcgccctggccagagcccgagaaggcttatctcgctggtgtcaaagctggatagcggtgtgcccgaccggttcagcggctcagggtcaggaaccgatttcaccttgaagatctcccgcgtggaagccgaagatgtcggagtctactactgctggcagggtactcacttcccggggacctttggtggcggcactaaggtcgagattaagggctcacaccatcatcaccatcaccaccac

SEQ ID NO: 430 - protein, 277 aa, Artificial Sequence
  Description of Artificial Sequence: Synthetic polypeptide
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 431 - DNA, 1470 bp, Artificial Sequence
  Description of Artificial Sequence: Synthetic polynucleotide
atggccctccctgtcaccgccctgctgcttccgctggctcttctgctccacgccgctcggcccgaaatccagctggtgcaaagcggagccgaggtgaagaagcccggagaatccctgcgcatctcgtgtaagggttccggctttaacatcgaggattactacatccactgggtgagacagatgccgggcaaaggtctggaatggatgggccgcatcgacccggagaacgacgaaaccaaatacggaccaatcttccaaggacatgtgactatttccgcggatacctccatcaacactgtctacttgcagtggagctcgctcaaggcgtcggataccgccatgtactactgcgcattcagaggaggtgtgtactggggccagggcactacggtcaccgtgtcctcgggaggtggagggtcaggaggcggaggctcgggcggtggaggatcaggcggaggaggaagcgatgtggtcatgactcaatccccactgtcactgcctgtcactctggggcaaccggcttccatctcatgcaagtcaagccaatcgctgctcgactccgacggaaaaacctacctcaattggcttcagcagcgcccaggccagtcgcctcggaggctgatctcactcgtgtcgaagcttgactccggggtgccggatcggtttagcggaagcggatcggggaccgacttcacgttgaagattagccgggtggaagccgaggacgtgggagtctattactgctggcaggggacccacttcccggggactttcggaggaggcaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 432 - protein, 490 aa, Artificial Sequence
  Description of Artificial Sequence: Synthetic polypeptide
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 433 - protein, 246 aa, Artificial Sequence
  Description of Artificial Sequence: Synthetic polypeptide
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 434 - DNA, 738 bp, Artificial Sequence
  Description of Artificial Sequence: Synthetic polynucleotide
gacgtcgtcatgacccagagcccgctgtcactgcctgtgaccctgggccagccggcgtccattagctgcaaatcctcgcaatccctgctcgactcagacggaaaaacgtacttgaactggctccaacagcgccctgggcaatccccaaggcggcttatctcactcgtcagcaagctcgatagcggtgtcccagacagattttcgggctcgggatcgggcactgatttcactctgaagatctcgcgggtggaagccgaggatgtgggagtgtactattgctggcagggcactcacttccccgggacgtttggcggaggaactaaggtcgagatcaaaggaggaggtggatcaggcggaggtgggagcggaggaggaggaagcggtggtggaggttccgaaatccagctggtgcaatcaggagccgaggtgaagaagccgggagaatccctgcgcatctcgtgcaagggctcgggcttcaacatcgaggattactacatccactgggtgcggcagatgccgggaaaggggttggaatggatgggacgcattgacccggaaaatgatgaaaccaaatacgggccaatcttccaaggccacgtgaccattagcgctgacacttccatcaacaccgtgtaccttcagtggtcctcactgaaggcgtcggacactgccatgtactactgtgcattcagaggaggggtctactggggacagggcaccaccgtgaccgtgagctcc

SEQ ID NO: 435 - DNA, 831 bp, Artificial Sequence
  Description of Artificial Sequence: Synthetic polynucleotide
atggccctccctgtcaccgccctgctgcttccgctggctcttctgctccacgccgctcggcccgacgtcgtcatgacccagagcccgctgtcactgcctgtgaccctgggccagccggcgtccattagctgcaaatcctcgcaatccctgctcgactcagacggaaaaacgtacttgaactggctccaacagcgccctgggcaatccccaaggcggcttatctcactcgtcagcaagctcgatagcggtgtcccagacagattttcgggctcgggatcgggcactgatttcactctgaagatctcgcgggtggaagccgaggatgtgggagtgtactattgctggcagggcactcacttccccgggacgtttggcggaggaactaaggtcgagatcaaaggaggaggtggatcaggcggaggtgggagcggaggaggaggaagcggtggtggaggttccgaaatccagctggtgcaatcaggagccgaggtgaagaagccgggagaatccctgcgcatctcgtgcaagggctcgggcttcaacatcgaggattactacatccactgggtgcggcagatgccgggaaaggggttggaatggatgggacgcattgacccggaaaatgatgaaaccaaatacgggccaatcttccaaggccacgtgaccattagcgctgacacttccatcaacaccgtgtaccttcagtggtcctcactgaaggcgtcggacactgccatgtactactgtgcattcagaggaggggtctactggggacagggcaccaccgtgaccgtgagctccggctcgcatcaccatcatcaccaccatcac

SEQ ID NO: 436 - protein, 277 aa, Artificial Sequence
  Description of Artificial Sequence: Synthetic polypeptide
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHH

SEQ ID NO: 437 - DNA, 1470 bp, Artificial Sequence
  Description of Artificial Sequence: Synthetic polynucleotide
atggccctccctgtcaccgccctgctgcttccgctggctcttctgctccacgccgctcggcccgacgtcgtcatgacccaatcccctctctccctgccggtcaccctgggtcagccggcgtcgatctcatgcaaaagctcacagtccctgctggattcggacggaaaaacctacttgaactggctccaacagaggccgggtcagtcccctcgcagactgatctcgctggtgagcaagctcgactcgggtgtgccggatcggttctccgggtcaggatcgggcaccgactttacgctcaagatttcgagagtggaggccgaggatgtgggagtgtactattgctggcagggcacgcatttccccgggacctttggaggcgggactaaggtggaaatcaagggaggtggcggatcaggcggaggaggcagcggcggaggtggatcaggaggcggagggtcagagatccagctggtccaaagcggagcagaggtgaagaagccaggcgagtcccttcgcatttcgtgcaaagggagcggcttcaacattgaagattactacatccactgggtgcggcaaatgccaggaaagggtctggaatggatgggacggatcgacccagaaaatgatgaaactaagtacggaccgatcttccaaggacacgtcactatctccgcggacacttcgatcaacaccgtgtacctccagtggagcagcttgaaagcctccgacaccgctatgtactactgtgccttccgcggaggagtctactggggacaggggactactgtgaccgtgtcgtccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 438 - protein, 490 aa, Artificial Sequence
  Description of Artificial Sequence: Synthetic polypeptide
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 439 - protein, 246 aa, Artificial Sequence
  Description of Artificial Sequence: Synthetic polypeptide
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 440 - DNA, 738 bp, Artificial Sequence
  Description of Artificial Sequence: Synthetic polynucleotide
gaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaa

SEQ ID NO: 441 - DNA, 831 bp, Artificial Sequence
  Description of Artificial Sequence: Synthetic polynucleotide
atggccctccctgtcaccgccctgctgcttccgctggctcttctgctccacgccgctcggcccgaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaagggagccaccatcatcatcaccaccaccac

SEQ ID NO: 442 - protein, 277 aa, Artificial Sequence
  Description of Artificial Sequence: Synthetic polypeptide
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 443 - DNA, 1470 bp, Artificial Sequence
  Description of Artificial Sequence: Synthetic polynucleotide
atggccctccctgtcaccgccctgctgcttccgctggctcttctgctccacgccgctcggcccgaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 444 - protein, 490 aa, Artificial Sequence
  Description of Artificial Sequence: Synthetic polypeptide
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 445 - protein, 246 aa, Artificial Sequence
  Description of Artificial Sequence: Synthetic polypeptide
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 446 - DNA, 738 bp, Artificial Sequence
  Description of Artificial Sequence: Synthetic polynucleotide
gaaatccagctggtgcagtcaggcgccgaggtcaagaagccgggagagtcgctgagaatctcgtgcaagggctcggggttcaacatcgaggactactacattcactgggtcaggcagatgccgggaaagggactggaatggatgggccggatcgacccagaaaatgacgaaaccaaatacgggccgatttttcaaggccacgtgactatcagcgcagacacgagcatcaacactgtctacctccagtggtcctcgcttaaggccagcgataccgctatgtactactgcgcattcagaggcggggtgtactggggacaaggaaccactgtgaccgtgagcagcggaggtggcggctcgggaggaggtgggagcggaggaggaggttccggcggtggaggatcagatgtcgtgatgacccagtccccggactccctcgctgtctcactgggcgagcgcgcgaccatcaactgcaaatcgagccagtcgctgttggactccgatggaaagacttatctgaattggctgcaacagaaaccaggacaacctcccaagcggctcatctcgcttgtgtcaaaactcgattcgggagtgccagaccgcttctcggggtccgggagcggaactgactttactttgaccatttcctcactgcaagcggaggatgtggccgtgtattactgttggcagggcacgcatttccctggaaccttcggtggcggaactaaggtggaaatcaag

SEQ ID NO: 447 - DNA, 834 bp, Artificial Sequence
  Description of Artificial Sequence: Synthetic polynucleotide
atggccctccctgtcaccgccctgctgcttccgctggctcttctgctccacgccgctcggcccgaaatccagctggtgcagtcaggcgccgaggtcaagaagccgggagagtcgctgagaatctcgtgcaagggctcggggttcaacatcgaggactactacattcactgggtcaggcagatgccgggaaagggactggaatggatgggccggatcgacccagaaaatgacgaaaccaaatacgggccgatttttcaaggccacgtgactatcagcgcagacacgagcatcaacactgtctacctccagtggtcctcgcttaaggccagcgataccgctatgtactactgcgcattcagaggcggggtgtactggggacaaggaaccactgtgaccgtgagcagcggaggtggcggctcgggaggaggtgggagcggaggaggaggttccggcggtggaggatcagatgtcgtgatgacccagtccccggactccctcgctgtctcactgggcgagcgcgcgaccatcaactgcaaatcgagccagtcgctgttggactccgatggaaagacttatctgaattggctgcaacagaaaccaggacaacctcccaagcggctcatctcgcttgtgtcaaaactcgattcgggagtgccagaccgcttctcggggtccgggagcggaactgactttactttgaccatttcctcactgcaagcggaggatgtggccgtgtattactgttggcagggcacgcatttccctggaaccttcggtggcggaactaaggtggaaatcaagggatcacaccaccatcatcaccatcaccaccat

SEQ ID NO: 448 - protein, 278 aa, Artificial Sequence
  Description of Artificial Sequence: Synthetic polypeptide
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHHH

SEQ ID NO: 449 - DNA, 1470 bp, Artificial Sequence
  Description of Artificial Sequence: Synthetic polynucleotide
atggccctccctgtcaccgccctgctgcttccgctggctcttctgctccacgccgctcggcccgagattcagctcgtgcaatcgggagcggaagtcaagaagccaggagagtccttgcggatctcatgcaagggtagcggctttaacatcgaggattactacatccactgggtgaggcagatgccggggaagggactcgaatggatgggacggatcgacccagaaaacgacgaaactaagtacggtccgatcttccaaggccatgtgactattagcgccgatacttcaatcaataccgtgtatctgcaatggtcctcattgaaagcctcagataccgcgatgtactactgtgctttcagaggaggggtctactggggacagggaactaccgtgactgtctcgtccggcggaggcgggtcaggaggtggcggcagcggaggaggagggtccggcggaggtgggtccgacgtcgtgatgacccagagccctgacagcctggcagtgagcctgggcgaaagagctaccattaactgcaaatcgtcgcagagcctgctggactcggacggaaaaacgtacctcaattggctgcagcaaaagcctggccagccaccgaagcgccttatctcactggtgtcgaagctggattcgggagtgcccgatcgcttctccggctcgggatcgggtactgacttcaccctcactatctcctcgcttcaagcagaggacgtggccgtctactactgctggcagggaacccactttccgggaaccttcggcggagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 450 - protein, 490 aa, Artificial Sequence
  Description of Artificial Sequence: Synthetic polypeptide
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 451 - protein, 246 aa, Artificial Sequence
  Description of Artificial Sequence: Synthetic polypeptide
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 452 - DNA, 738 bp, Artificial Sequence
  Description of Artificial Sequence: Synthetic polynucleotide
gacgtggtgatgacccaatcgccagattccctggcagtgtccctgggcgaacgcgccactattaactgcaaatcgtcacagtccttgcttgattccgacggaaagacctacctcaattggctccagcagaagccaggacaaccgccaaagagactgatctccctggtgtcaaagctggactcgggagtgcctgatcggttctcgggtagcgggagcggcaccgacttcactctgaccatctcgtcactccaggctgaggacgtggccgtgtattactgttggcagggtactcactttccgggcactttcggaggcggcaccaaggtggagattaaaggaggaggcggaagcggaggtggaggatcgggaggtggtgggagcggcggaggagggagcgagatccagctcgtccaatcgggagcggaagtgaagaagcccggagagtcacttagaatctcatgcaaggggtcgggcttcaacatcgaggattactacatccattgggtccgccagatgcctggtaaaggactggaatggatggggaggattgacccggaaaacgacgaaactaagtacggaccgatctttcaagggcacgtgactatctccgctgatacctcaatcaatactgtctacctccagtggtcctcgctgaaagcaagcgacaccgcgatgtactactgcgccttccggggaggagtgtactggggccaaggcaccacggtcacggtcagctcc

SEQ ID NO: 453 - DNA, 834 bp, Artificial Sequence
  Description of Artificial Sequence: Synthetic polynucleotide
atggccctccctgtcaccgccctgctgcttccgctggctcttctgctccacgccgctcggcccgacgtggtgatgacccaatcgccagattccctggcagtgtccctgggcgaacgcgccactattaactgcaaatcgtcacagtccttgcttgattccgacggaaagacctacctcaattggctccagcagaagccaggacaaccgccaaagagactgatctccctggtgtcaaagctggactcgggagtgcctgatcggttctcgggtagcgggagcggcaccgacttcactctgaccatctcgtcactccaggctgaggacgtggccgtgtattactgttggcagggtactcactttccgggcactttcggaggcggcaccaaggtggagattaaaggaggaggcggaagcggaggtggaggatcgggaggtggtgggagcggcggaggagggagcgagatccagctcgtccaatcgggagcggaagtgaagaagcccggagagtcacttagaatctcatgcaaggggtcgggcttcaacatcgaggattactacatccattgggtccgccagatgcctggtaaaggactggaatggatggggaggattgacccggaaaacgacgaaactaagtacggaccgatctttcaagggcacgtgactatctccgctgatacctcaatcaatactgtctacctccagtggtcctcgctgaaagcaagcgacaccgcgatgtactactgcgccttccggggaggagtgtactggggccaaggcaccacggtcacggtcagctccggctcccatcaccaccaccatcaccatcatcac

SEQ ID NO: 454 - protein, 278 aa, Artificial Sequence
  Description of Artificial Sequence: Synthetic polypeptide
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHHH

SEQ ID NO: 455 - DNA, 1470 bp, Artificial Sequence
  Description of Artificial Sequence: Synthetic polynucleotide
atggccctccctgtcaccgccctgctgcttccgctggctcttctgctccacgccgctcggcccgacgtggtgatgactcagtcgcctgactcgctggctgtgtcccttggagagcgggccactatcaattgcaagtcatcccagtcgctgctggattccgacgggaaaacctacctcaattggctgcagcaaaaaccgggacagcctccaaagcggctcatcagcctggtgtccaagttggacagcggcgtgccagaccgcttctccggttcgggaagcggtactgatttcacgctgaccatctcatccctccaagcggaggatgtggcagtctactactgttggcagggcacgcattttccgggcacttttggaggagggaccaaggtcgaaatcaagggaggaggtggctcgggcggaggaggctcgggaggaggaggatcaggaggcggtggaagcgagattcaactggtccagagcggcgcagaagtcaagaagccgggtgaatcgctcagaatctcgtgcaaaggatcgggattcaacatcgaggactactacattcactgggtcagacaaatgccgggcaaagggctggaatggatggggaggatcgaccccgaaaacgatgaaaccaagtacggaccaatcttccaagggcacgtgaccatttcggcggacacctcaatcaacactgtgtacctccagtggagctcacttaaggccagcgataccgccatgtactattgcgctttccgcggaggggtgtactggggacagggcactactgtgaccgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 456 - protein, 490 aa, Artificial Sequence
  Description of Artificial Sequence: Synthetic polypeptide
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 457 - protein, 246 aa, Artificial Sequence
  Description of Artificial Sequence: Synthetic polypeptide
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 458 - DNA, 738 bp, Artificial Sequence
  Description of Artificial Sequence: Synthetic polynucleotide
gatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcg

SEQ ID NO: 459 - DNA, 831 bp, Artificial Sequence
  Description of Artificial Sequence: Synthetic polynucleotide
atggccctccctgtcaccgccctgctgcttccgctggctcttctgctccacgccgctcggcccgatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcggggtcccaccatcatcaccaccaccatcac

SEQ ID NO: 460 - protein, 277 aa, Artificial Sequence
  Description of Artificial Sequence: Synthetic polypeptide
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 461 - DNA, 1470 bp, Artificial Sequence
  Description of Artificial Sequence: Synthetic polynucleotide
atggccctccctgtcaccgccctgctgcttccgctggctcttctgctccacgccgctcggcccgatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 462 - protein, 490 aa, Artificial Sequence
  Description of Artificial Sequence: Synthetic polypeptide
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 463 - protein, 243 aa, Artificial Sequence
  Description of Artificial Sequence: Synthetic polypeptide
EIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 464 - DNA, 729 bp, Artificial Sequence
  Description of Artificial Sequence: Synthetic polynucleotide
gagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaag

SEQ ID NO: 465 - DNA, 822 bp, Artificial Sequence
  Description of Artificial Sequence: Synthetic polynucleotide
atggccctccctgtcaccgccctgctgcttccgctggctcttctgctccacgccgctcggcccgagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaagggtagccatcaccatcaccaccaccatcat

SEQ ID NO: 466 - protein, 274 aa, Artificial Sequence
  Description of Artificial Sequence: Synthetic polypeptide
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKGSHHHHHHHH

SEQ ID NO: 467 - DNA, 1461 bp, Artificial Sequence
  Description of Artificial Sequence: Synthetic polynucleotide
atggccctccctgtcaccgccctgctgcttccgctggctcttctgctccacgccgctcggcccgagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 468 - protein, 487 aa, Artificial Sequence
  Description of Artificial Sequence: Synthetic polypeptide
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 469 - protein, 240 aa, Artificial Sequence
  Description of Artificial Sequence: Synthetic polypeptide
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 470 - DNA, 720 bp, Artificial Sequence
  Description of Artificial Sequence: Synthetic polynucleotide
gatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctcc

SEQ ID NO: 471 - DNA, 807 bp, Artificial Sequence
  Description of Artificial Sequence: Synthetic polynucleotide
atggccctccctgtcaccgccctgctgcttccgctggctcttctgctccacgccgctcggcccgatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctcccatcaccatcaccaccaccatcac

SEQ ID NO: 472 - protein, 269 aa, Artificial Sequence
  Description of Artificial Sequence: Synthetic polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSHHHHHHHH

SEQ ID NO: 473 - DNA, 1452 bp, Artificial Sequence
  Description of Artificial Sequence: Synthetic polynucleotide
atggccctccctgtcaccgccctgctgcttccgctggctcttctgctccacgccgctcggcccgatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 474 - protein, 484 aa, Artificial Sequence
  Description of Artificial Sequence: Synthetic polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 475 - DNA, 1482 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaagccaggagaatcactcaagattagctgcaaaggcagcggctactccttcacttcctactggatcggctgggtgcgccagatgcccggaaagggactggagtggatgggaatcatctaccctggcgatagcgacaccagatactccccgagctttcaaggccaagtgaccatttcggccgacaagtcgatctccaccgcgtatctgcagtggagctcactgaaggcttcggacaccgccatgtactactgtgcccggctggggggaagcctgcccgattacggaatggacgtgtggggccagggaaccatggtcactgtgtcctccgcctccgggggtggaggctccggtggaggggggtccggtggtggaggatcagaaattgtgctgacccagtctccgctgtccttgcctgtgaccccgggcgaacccgcaagcatctcctgccggtcgtcgcagtccctgcttcactccaacggctacaactacctcgattggtacctccagaagcctggacagagcccacagctgttgatctacctgggctcgaaccgggcctcaggagtgccggacaggttctccggctccgggtcgggaaccgacttcacgctgaagatctcccgcgtggaggccgaggacgtgggcgtgtactattgcatgcaggcgctgcagacccttattacattcggacaggggactaaggtcgatatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 476 - protein, 494 aa, Artificial Sequence
  Description of Artificial Sequence: Synthetic polypeptide
MALPVTALLLPLALLLHAARPQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 477 - protein, 271 aa, Artificial Sequence
  Description of Artificial Sequence: Synthetic polypeptide
MALPVTALLLPLALLLHAARPQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 478 - protein, 121 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSS

SEQ ID NO: 479 - protein, 112 aa, Artificial Sequence
  Description of Artificial Sequence: Synthetic polypeptide
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 480 - DNA, 1485 bp, Artificial Sequence
  Description of Artificial Sequence: Synthetic polynucleotide
atggccctccctgtcaccgccctgctgcttccgctggctcttctgctccacgccgctcggccccaagtccaactcgtccaatcaggagctgaagtcaagaagcctggagcatccgtgagagtgtcctgtaaagcctccggctacatcttcaccaactactacgtgcactgggtcagacaggccccgggccagggactggaatggatgggaatcatttccccgtccggcggatcgcctacttacgcgcaacggctgcagggccgcgtgaccatgactcgggatctctccacttcaaccgtgtacatggaactgtccagccttacatcggaggatactgccgtgtacttctgcgcgagggagtcccggctgaggggcaaccgcctcgggctgcagtcaagcatcttcgatcactggggccagggcaccctcgtgaccgtgtccagcgcctcggggggaggaggctccgggggcggaggttcgggcggtggtggatctgacattcgcatgactcagtccccaccttcactgtccgctagcgtgggggaccgcgtgacgattccgtgccaagccagccaggacatcaacaaccatctgaactggtatcagcagaagcccggaaaggccccgcagctgctgatctacgacacctcgaatctggagatcggcgtgccatcccggttctccggttcgggaagcggaaccgactttaccctgactatctcctccttgcaacccgaggacattgccacctactactgccagcagtacgaaaaccttcccctgaccttcgggggtggaaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 481 - protein, 495 aa, Artificial Sequence
  Description of Artificial Sequence: Synthetic polypeptide
MALPVTALLLPLALLLHAARPQVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 482 - protein, 272 aa, Artificial Sequence
  Description of Artificial Sequence: Synthetic polypeptide
MALPVTALLLPLALLLHAARPQVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 483 - protein, 127 aa, Artificial Sequence
  Description of Artificial Sequence: Synthetic polypeptide
QVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSS

SEQ ID NO: 484 - protein, 107 aa, Artificial Sequence
  Description of Artificial Sequence: Synthetic polypeptide
DIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 485 - DNA, 1479 bp, Artificial Sequence
  Description of Artificial Sequence: Synthetic polynucleotide
atggccctccctgtcaccgccctgctgcttccgctggctcttctgctccacgccgctcggccccaagtgcaattggtgcagtcaggaggaggattggtgcaacccggaggatcgctgagactgtcatgtgctgccagcgggttcacattctcctcctacgcaatgtcctgggtccgccaggcgccgggcaaaggactggaatgggtgtccgccatctcggggtcgggcggctccacctattacgctgactccgtgaagggacgcttcaccattagcagagataactccaagaacaccctctacctccaaatgaacagccttagggctgaggacaccgccgtctattactgcgccaaggaggacacgatccggggacctaactactattactacggaatggatgtctggggccagggtaccactgtgaccgtgtcctcggcctcgggaggcggaggatcagggggtggtggctctggggggggtggcagcgaaactactctgacccagtccccctcatccgtgtcagcgtccgtgggcgatcgggtgtcgatcacttgccgggcctcccaagacatcgacacctggctcgcgtggtaccagctgaagccaggaaaggcccctaagctgctgatgtacgcagcctccaatctgcaaggaggggtgccctcccgcttttccgggtccggcagcggaaccgacttcattctgactatctcgagcctccagccggaggatttcgccacctactactgccagcaggcctccatcttcccgccgactttcggtggcggaaccaaggtcgacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 486 - protein, 493 aa, Artificial Sequence
  Description of Artificial Sequence: Synthetic polypeptide
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 487 - protein, 270 aa, Artificial Sequence
  Description of Artificial Sequence: Synthetic polypeptide
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 488 - protein, 125 aa, Artificial Sequence
  Description of Artificial Sequence: Synthetic polypeptide
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSS

SEQ ID NO: 489 - protein, 107 aa, Artificial Sequence
  Description of Artificial Sequence: Synthetic polypeptide
ETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 490 - DNA, 1482 bp, Artificial Sequence
  Description of Artificial Sequence: Synthetic polynucleotide
atggccctccctgtcaccgccctgctgcttccgctggctcttctgctccacgccgctcggccccaagtgcagctcgtccaatccggtgcagaagtgaagaagcctggcgaatccctgaagatctcatgcaaaggctcgggatacagcttcacctcatattggattggatgggtcagacagatgccaggaaagggtctggagtggatgggaatcatctacccgggagacagcgatacccggtactccccgagcttccagggacaggtcaccatctcggccgacaagtccattactactgcctacttgcaatggtcctcgctgcgcgcctccgatagcgccatgtactactgcgcgagaggcggctactccgactacgactactacttcgatttctggggacaggggacactcgtgactgtgtcctccgcgtcgggtggcggcggctcgggtggaggaggaagcggagggggaggctccgaaattgtgatgacccagtcacccctgtcgctccctgtgactcctggggaaccggcctccatctcctgccggagctcacagagcctgctgcactccaacggatacaactacctcgattggtaccttcagaagcccggccagtcgccccagctgctgatctacctggggtccaaccgggctagcggcgtgccggaccgcttctccggttccgggtctggaaccgacttcacgctgaaaatctccagggtggaggccgaggacgtgggagtgtattactgtatgcaggccctgcaaacccccttcacctttggcgggggcaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 491 - protein, 494 aa, Artificial Sequence
  Description of Artificial Sequence: Synthetic polypeptide
MALPVTALLLPLALLLHAARPQVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 492 - protein, 271 aa, Artificial Sequence
  Description of Artificial Sequence: Synthetic polypeptide
MALPVTALLLPLALLLHAARPQVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 493 - protein, 121 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSS

SEQ ID NO: 494 - protein, 112 aa, Artificial Sequence
  Description of Artificial Sequence: Synthetic polypeptide
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 495 - DNA, 1452 bp, Artificial Sequence
  Description of Artificial Sequence: Synthetic polynucleotide
atggccctccctgtcaccgccctgctgcttccgctggctcttctgctccacgccgctcggccccaagtgcaactcgtccaaagcggtggagatctcgcccagcccggaagatcccttagactctcatgtgccgccagcgggttcaccttcgacgactacgctatgcattgggtgcgccaggccccggggaagggactggaatgggtggccgtgatttggccggacggcggacagaagtactacggagacagcgtgaaagggcggttcaccgtgtcgagggacaacccgaagaataccctctaccttcaaatgaactccctgcgcgccgaggacaccgcgatctactactgcgtgcgccactttaacgcatgggattactggggacaggggactctggtcactgtgtcctccgcctctggcggcggaggttccggcggtggtggctccggtggaggaggatcggacatccagctgacccagtccccttcctcactgtcggcgtacgtgggaggccgggtcactatcacgtgccaggcatcccagggcatttcccagttcctgaactggttccagcagaagcccggaaaggcccctaagctgttgatttccgatgctagcaacctggaacccggcgtgccgtcacggttcagcggctccgggtcgggcaccgacttcaccttcaccatcactaacctccaaccggaggacatcgccacctattactgccagcagtacgatgatctgccactgactttcggcggcggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 496 - protein, 484 aa, Artificial Sequence
  Description of Artificial Sequence: Synthetic polypeptide
MALPVTALLLPLALLLHAARPQVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 497 - protein, 261 aa, Artificial Sequence
  Description of Artificial Sequence: Synthetic polypeptide
MALPVTALLLPLALLLHAARPQVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 498 - protein, 116 aa, Artificial Sequence
  Description of Artificial Sequence: Synthetic polypeptide
QVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSS

SEQ ID NO: 499 - protein, 107 aa, Artificial Sequence
  Description of Artificial Sequence: Synthetic polypeptide
DIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 500 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcaactcgtccaatccggtggtggtgtcgtgcaaccaggaaagtctcttcgcctctcatgcgctgccagcggattcacgttttccatcttcgctatgcactgggtgcggcaggccccgggaaagggactggaatgggtggcaaccatttcatacgatggatcaaacgcgttctacgccgactccgtggaaggaaggttcaccatctcgagagacaactccaaggactcgctgtatctgcaaatggactccctgcgccctgaggataccgccgtctactactgcgtgaaggccggcgacgggggatacgacgtgttcgattcgtggggccagggaactctggtcaccgtgtccagcgcgagcgggggaggcggatcgggtggtggagggtccgggggaggaggctccgagatcgtgatgactcagtcgccgctctccctccccgtgacccccggagagccagctagcatttcatgtcggagctcccagtccctgctgcactccaacggctacaattacctggattggtacttgcagaagcctgggcagagccctcagctgctgatctacctcggctcgaacagagcctccggcgtgccggaccggttttccgggagcggcagcggcaccgatttcaccttgaaaatctcccgcgtggaagccgaggacgtgggcgtgtactattgcatgcaggccctgcagactcccaccttcggcccgggaactaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 501 - protein, 492 aa, Artificial Sequence
  Description of Artificial Sequence: Synthetic polypeptide
MALPVTALLLPLALLLHAARPQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 502 - protein, 269 aa, Artificial Sequence
  Description of Artificial Sequence: Synthetic polypeptide
MALPVTALLLPLALLLHAARPQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 503 - protein, 120 aa, Artificial Sequence
  Description of Artificial Sequence: Synthetic polypeptide
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 504 - protein, 111 aa, Artificial Sequence
  Description of Artificial Sequence: Synthetic polypeptide
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 505 - DNA, 1467 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatctggaggaggattggtgcaacctggaggatctctgagactgtcatgtgccgccagcggcttcacattttcctcctacgcgatgtcatgggtccgccaggcaccggggaaaggactggaatgggtgtccgccatttcgggatcgggaggctcgacctactacgccgacagcgtgaagggaagattcactatctcccgggataactccaagaatactctgtatctccaaatgaactccctgagggccgaggatactgccgtgtactactgcgctaaggaaaccgactactacggctcaggaaccttcgactactggggccagggcaccctcgtgaccgtgtcctcggcctccggcggcggaggttcgggggggggcggttccgggggagggggcagcgacatccagatgacccagtccccaagctccctttccgcgtccgtgggagatcgcgtgaccatttcgtgccgggctagccagggcatcggtatctatcttgcgtggtaccagcagcggagcggaaagccgccccagctgctgatccacggcgcctcaactctgcaatccggggtccccagccggttcagcggtagcgggtcgggtaccgactttaccctgactatctcctccctccaaccggaggacttcgcctcctactggtgccagcagtccaacaacttccctcccaccttcggccagggaacgaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 506 - protein, 489 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 507 - protein, 266 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 508 - protein, 121 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSS

SEQ ID NO: 509 - protein, 107 aa, Artificial Sequence
  Description of Artificial Sequence: Synthetic polypeptide
DIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 510 - DNA, 1467 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaagccaggagcctccgtgagagtgtcgtgcaaagcgtccggctacatgttcaccgactttttcattcactgggtgcgccaggcgcccggacagggtctggagtggatggggtggatcaaccctaactccggcgtgactaaatacgcccagaagttccagggccgcgtgaccatgacccggaacactagcatctccaccgcctacatggaactgtcatccctccggtccgaggataccgccgtgtactactgcgccacctggtacagcagcggttggtacggcatcgcgaacatttggggacaggggactatggtcaccgtgtcatccgcctccgggggaggagggtccggcggcggaggttctggaggaggcggctcggacatccagttgacgcagagcccctcgtcgctgagcgcctccgtgggcgacagagtgaccattacctgtcaagcttcccatgatatctcgaactacctccactggtatcagcagaagccgggaaaggctcccaagctgctgatctacgacgcctccaatctggaaaccggagtgccgagccggttcactggatcagggagcggcactgacttcaccctgacaattaggtcgctgcagccggaggatgtggcagcctactactgccaacagtcagacgaccttcctcacactttcggacaagggactaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 511 - protein, 489 aa, Artificial Sequence
  Description of Artificial Sequence: Synthetic polypeptide
MALPVTALLLPLALLLHAARPQVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 512 - protein, 266 aa, Artificial Sequence
  Description of Artificial Sequence: Synthetic polypeptide
MALPVTALLLPLALLLHAARPQVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 513 - protein, 121 aa, Artificial Sequence
  Description of Artificial Sequence: Synthetic polypeptide
QVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSS

SEQ ID NO: 514 - protein, 107 aa, Artificial Sequence
  Description of Artificial Sequence: Synthetic polypeptide
DIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 515 - DNA, 1464 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtgaaaaagccaggagaaagcctcaagatcagctgcaagggatctgggtacagcttcaccaactactggatcggctgggtgcgccagatgcccggaaagggactggagtggatgggcattatctaccctggggactccgacacccggtattccccgagcttccaaggacaggtcaccatctccgccgataagtcgattagcactgcgtacttgcagtggtcaagcctgaaggcctcggacaccgccatgtactactgcgcgagacacgggccctcgtcctggggcgaatttgactactggggccagggaacgcttgtgaccgtgtcgtccgcgtccgggggtggaggatcaggaggaggaggctccggtggtggcggtagcgacatccggctgactcagtccccttcctcactctccgcctccgtgggggaccgcgtgaccattacctgtcgggcatcacagtccatcagctcatacctgaactggtatcagcagaagccggggaaggccccgaaactcctgatctacgccgcctcctccctgcaatccggcgtgccctcgaggttctccggctccggctcgggaaccgatttcactctgacaattagcagcctgcagcctgaggatttcgctacctactactgccagcagtcctactcgactccgctgactttcggcgggggaaccaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 516 - protein, 488 aa, Artificial Sequence
  Description of Artificial Sequence: Synthetic polypeptide
MALPVTALLLPLALLLHAARPQVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 517 - protein, 265 aa, Artificial Sequence
  Description of Artificial Sequence: Synthetic polypeptide
MALPVTALLLPLALLLHAARPQVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 518 - protein, 120 aa, Artificial Sequence
  Description of Artificial Sequence: Synthetic polypeptide
QVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSS

SEQ ID NO: 519 - protein, 107 aa, Artificial Sequence
  Description of Artificial Sequence: Synthetic polypeptide
DIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 520 - DNA, 750 bp, Artificial Sequence
  Description of Artificial Sequence: Synthetic polynucleotide
caagtgcaactcgtccagtccggtgcagaagtcaagaagccaggagaatcactcaagattagctgcaaaggcagcggctactccttcacttcctactggatcggctgggtgcgccagatgcccggaaagggactggagtggatgggaatcatctaccctggcgatagcgacaccagatactccccgagctttcaaggccaagtgaccatttcggccgacaagtcgatctccaccgcgtatctgcagtggagctcactgaaggcttcggacaccgccatgtactactgtgcccggctggggggaagcctgcccgattacggaatggacgtgtggggccagggaaccatggtcactgtgtcctccgcctccgggggtggaggctccggtggaggggggtccggtggtggaggatcagaaattgtgctgacccagtctccgctgtccttgcctgtgaccccgggcgaacccgcaagcatctcctgccggtcgtcgcagtccctgcttcactccaacggctacaactacctcgattggtacctccagaagcctggacagagcccacagctgttgatctacctgggctcgaaccgggcctcaggagtgccggacaggttctccggctccgggtcgggaaccgacttcacgctgaagatctcccgcgtggaggccgaggacgtgggcgtgtactattgcatgcaggcgctgcagacccttattacattcggacaggggactaaggtcgatatcaag

SEQ ID NO: 521 - protein, 250 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 522 - DNA, 753 bp, Artificial Sequence
  Description of Artificial Sequence: Synthetic polynucleotide
caagtccaactcgtccaatcaggagctgaagtcaagaagcctggagcatccgtgagagtgtcctgtaaagcctccggctacatcttcaccaactactacgtgcactgggtcagacaggccccgggccagggactggaatggatgggaatcatttccccgtccggcggatcgcctacttacgcgcaacggctgcagggccgcgtgaccatgactcgggatctctccacttcaaccgtgtacatggaactgtccagccttacatcggaggatactgccgtgtacttctgcgcgagggagtcccggctgaggggcaaccgcctcgggctgcagtcaagcatcttcgatcactggggccagggcaccctcgtgaccgtgtccagcgcctcggggggaggaggctccgggggcggaggttcgggcggtggtggatctgacattcgcatgactcagtccccaccttcactgtccgctagcgtgggggaccgcgtgacgattccgtgccaagccagccaggacatcaacaaccatctgaactggtatcagcagaagcccggaaaggccccgcagctgctgatctacgacacctcgaatctggagatcggcgtgccatcccggttctccggttcgggaagcggaaccgactttaccctgactatctcctccttgcaacccgaggacattgccacctactactgccagcagtacgaaaaccttcccctgaccttcgggggtggaaccaaagtggagatcaag

SEQ ID NO: 523 - protein, 251 aa, Artificial Sequence
  Description of Artificial Sequence: Synthetic polypeptide
QVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 524 - DNA, 750 bp, Artificial Sequence
  Description of Artificial Sequence: Synthetic polynucleotide
caagtgcagctcgtccaatccggtgcagaagtgaagaagcctggcgaatccctgaagatctcatgcaaaggctcgggatacagcttcacctcatattggattggatgggtcagacagatgccaggaaagggtctggagtggatgggaatcatctacccgggagacagcgatacccggtactccccgagcttccagggacaggtcaccatctcggccgacaagtccattactactgcctacttgcaatggtcctcgctgcgcgcctccgatagcgccatgtactactgcgcgagaggcggctactccgactacgactactacttcgatttctggggacaggggacactcgtgactgtgtcctccgcgtcgggtggcggcggctcgggtggaggaggaagcggagggggaggctccgaaattgtgatgacccagtcacccctgtcgctccctgtgactcctggggaaccggcctccatctcctgccggagctcacagagcctgctgcactccaacggatacaactacctcgattggtaccttcagaagcccggccagtcgccccagctgctgatctacctggggtccaaccgggctagcggcgtgccggaccgcttctccggttccgggtctggaaccgacttcacgctgaaaatctccagggtggaggccgaggacgtgggagtgtattactgtatgcaggccctgcaaacccccttcacctttggcgggggcaccaaggtcgagattaag

SEQ ID NO: 525 - protein, 250 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 526 - DNA, 720 bp, Artificial Sequence
  Description of Artificial Sequence: Synthetic polynucleotide
caagtgcaactcgtccaaagcggtggagatctcgcccagcccggaagatcccttagactctcatgtgccgccagcgggttcaccttcgacgactacgctatgcattgggtgcgccaggccccggggaagggactggaatgggtggccgtgatttggccggacggcggacagaagtactacggagacagcgtgaaagggcggttcaccgtgtcgagggacaacccgaagaataccctctaccttcaaatgaactccctgcgcgccgaggacaccgcgatctactactgcgtgcgccactttaacgcatgggattactggggacaggggactctggtcactgtgtcctccgcctctggcggcggaggttccggcggtggtggctccggtggaggaggatcggacatccagctgacccagtccccttcctcactgtcggcgtacgtgggaggccgggtcactatcacgtgccaggcatcccagggcatttcccagttcctgaactggttccagcagaagcccggaaaggcccctaagctgttgatttccgatgctagcaacctggaacccggcgtgccgtcacggttcagcggctccgggtcgggcaccgacttcaccttcaccatcactaacctccaaccggaggacatcgccacctattactgccagcagtacgatgatctgccactgactttcggcggcggaaccaaggtcgaaatcaag

SEQ ID NO: 527 - protein, 240 aa, Artificial Sequence
  Description of Artificial Sequence: Synthetic polypeptide
QVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 528 - DNA, 744 bp, Artificial Sequence
  Description of Artificial Sequence: Synthetic polynucleotide
caagtgcaactcgtccaatccggtggtggtgtcgtgcaaccaggaaagtctcttcgcctctcatgcgctgccagcggattcacgttttccatcttcgctatgcactgggtgcggcaggccccgggaaagggactggaatgggtggcaaccatttcatacgatggatcaaacgcgttctacgccgactccgtggaaggaaggttcaccatctcgagagacaactccaaggactcgctgtatctgcaaatggactccctgcgccctgaggataccgccgtctactactgcgtgaaggccggcgacgggggatacgacgtgttcgattcgtggggccagggaactctggtcaccgtgtccagcgcgagcgggggaggcggatcgggtggtggagggtccgggggaggaggctccgagatcgtgatgactcagtcgccgctctccctccccgtgacccccggagagccagctagcatttcatgtcggagctcccagtccctgctgcactccaacggctacaattacctggattggtacttgcagaagcctgggcagagccctcagctgctgatctacctcggctcgaacagagcctccggcgtgccggaccggttttccgggagcggcagcggcaccgatttcaccttgaaaatctcccgcgtggaagccgaggacgtgggcgtgtactattgcatgcaggccctgcagactcccaccttcggcccgggaactaaggtcgacatcaag

SEQ ID NO: 529 - protein, 248 aa, Artificial Sequence
  Description of Artificial Sequence: Synthetic polypeptide
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 530 - DNA, 735 bp, Artificial Sequence
  Description of Artificial Sequence: Synthetic polynucleotide
gaagtgcaattggtggaatctggaggaggattggtgcaacctggaggatctctgagactgtcatgtgccgccagcggcttcacattttcctcctacgcgatgtcatgggtccgccaggcaccggggaaaggactggaatgggtgtccgccatttcgggatcgggaggctcgacctactacgccgacagcgtgaagggaagattcactatctcccgggataactccaagaatactctgtatctccaaatgaactccctgagggccgaggatactgccgtgtactactgcgctaaggaaaccgactactacggctcaggaaccttcgactactggggccagggcaccctcgtgaccgtgtcctcggcctccggcggcggaggttcgggggggggcggttccgggggagggggcagcgacatccagatgacccagtccccaagctccctttccgcgtccgtgggagatcgcgtgaccatttcgtgccgggctagccagggcatcggtatctatcttgcgtggtaccagcagcggagcggaaagccgccccagctgctgatccacggcgcctcaactctgcaatccggggtccccagccggttcagcggtagcgggtcgggtaccgactttaccctgactatctcctccctccaaccggaggacttcgcctcctactggtgccagcagtccaacaacttccctcccaccttcggccagggaacgaaggtcgagattaag

SEQ ID NO: 531 - protein, 245 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 532 - DNA, 732 bp, Artificial Sequence
  Description of Artificial Sequence: Synthetic polynucleotide
caagtgcaactcgtccagtccggtgcagaagtgaaaaagccaggagaaagcctcaagatcagctgcaagggatctgggtacagcttcaccaactactggatcggctgggtgcgccagatgcccggaaagggactggagtggatgggcattatctaccctggggactccgacacccggtattccccgagcttccaaggacaggtcaccatctccgccgataagtcgattagcactgcgtacttgcagtggtcaagcctgaaggcctcggacaccgccatgtactactgcgcgagacacgggccctcgtcctggggcgaatttgactactggggccagggaacgcttgtgaccgtgtcgtccgcgtccgggggtggaggatcaggaggaggaggctccggtggtggcggtagcgacatccggctgactcagtccccttcctcactctccgcctccgtgggggaccgcgtgaccattacctgtcgggcatcacagtccatcagctcatacctgaactggtatcagcagaagccggggaaggccccgaaactcctgatctacgccgcctcctccctgcaatccggcgtgccctcgaggttctccggctccggctcgggaaccgatttcactctgacaattagcagcctgcagcctgaggatttcgctacctactactgccagcagtcctactcgactccgctgactttcggcgggggaaccaaggtcgacatcaag

SEQ ID NO: 533 - protein, 244 aa, Artificial Sequence
  Description of Artificial Sequence: Synthetic polypeptide
QVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 534 - protein, 244 aa, Artificial Sequence
  Description of Artificial Sequence: Synthetic polypeptide
QVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIK

SEQ ID NO: 535 - protein, 488 aa, Artificial Sequence
  Description of Artificial Sequence: Synthetic polypeptide
MALPVTALLLPLALLLHAARPQVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 536 - protein, 253 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 537 - protein, 497 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 538 - protein, 246 aa, Artificial Sequence
  Description of Artificial Sequence: Synthetic polypeptide
QVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 539 - protein, 490 aa, Artificial Sequence
  Description of Artificial Sequence: Synthetic polypeptide
MALPVTALLLPLALLLHAARPQVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 540 - protein, 242 aa, Artificial Sequence
  Description of Artificial Sequence: Synthetic polypeptide
QVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 541 - protein, 486 aa, Artificial Sequence
  Description of Artificial Sequence: Synthetic polypeptide
MALPVTALLLPLALLLHAARPQVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 542 - protein, 241 aa, Artificial Sequence
  Description of Artificial Sequence: Synthetic polypeptide
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 543 - protein, 485 aa, Artificial Sequence
  Description of Artificial Sequence: Synthetic polypeptide
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 544 - protein, 253 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIK

SEQ ID NO: 545 - protein, 497 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 546 - protein, 250 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 547 - protein, 494 aa, Artificial Sequence
  Description of Artificial Sequence: Synthetic polypeptide
MALPVTALLLPLALLLHAARPQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 548 - protein, 246 aa, Artificial Sequence
  Description of Artificial Sequence: Synthetic polypeptide
QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 549 - protein, 490 aa, Artificial Sequence
  Description of Artificial Sequence: Synthetic polypeptide
MALPVTALLLPLALLLHAARPQVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 550 - protein, 248 aa, Artificial Sequence
  Description of Artificial Sequence: Synthetic polypeptide
QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 551 - protein, 492 aa, Artificial Sequence
  Description of Artificial Sequence: Synthetic polypeptide
MALPVTALLLPLALLLHAARPQVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 552 - protein, 255 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 553 - protein, 499 aa, Artificial Sequence
  Description of Artificial Sequence: Synthetic polypeptide
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 554 - protein, 241 aa, Artificial Sequence
  Description of Artificial Sequence: Synthetic polypeptide
QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 555 - protein, 485 aa, Artificial Sequence
  Description of Artificial Sequence: Synthetic polypeptide
MALPVTALLLPLALLLHAARPQVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 556 - protein, 246 aa, Artificial Sequence
  Description of Artificial Sequence: Synthetic polypeptide
QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 557 - protein, 490 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 558 - protein, 249 aa, Artificial Sequence
  Description of Artificial Sequence: Synthetic polypeptide
QVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 559 - protein, 493 aa, Artificial Sequence
  Description of Artificial Sequence: Synthetic polypeptide
MALPVTALLLPLALLLHAARPQVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 560 - protein, 249 aa, Artificial Sequence
  Description of Artificial Sequence: Synthetic polypeptide
QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 561 - protein, 493 aa, Artificial Sequence
  Description of Artificial Sequence: Synthetic polypeptide
MALPVTALLLPLALLLHAARPQVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 562 - protein, 244 aa, Artificial Sequence
  Description of Artificial Sequence: Synthetic polypeptide
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 563 - protein, 488 aa, Artificial Sequence
  Description of Artificial Sequence: Synthetic polypeptide
MALPVTALLLPLALLLHAARPQVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 564 - protein, 246 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 565 - protein, 490 aa, Artificial Sequence
  Description of Artificial Sequence: Synthetic polypeptide
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 566 - protein, 246 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 567 - protein, 490 aa, Artificial Sequence
  Description of Artificial Sequence: Synthetic polypeptide
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 568 - protein, 251 aa, Artificial Sequence
  Description of Artificial Sequence: Synthetic polypeptide
QVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 569 - protein, 495 aa, Artificial Sequence
  Description of Artificial Sequence: Synthetic polypeptide
MALPVTALLLPLALLLHAARPQVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 570 - protein, 250 aa, Artificial Sequence
  Description of Artificial Sequence: Synthetic polypeptide
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 571 - protein, 494 aa, Artificial Sequence
  Description of Artificial Sequence: Synthetic polypeptide
MALPVTALLLPLALLLHAARPQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 572 - protein, 249 aa, Artificial Sequence
  Description of Artificial Sequence: Synthetic polypeptide
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 573 - protein, 493 aa, Artificial Sequence
  Description of Artificial Sequence: Synthetic polypeptide
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 574 - protein, 239 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 575 - protein, 383 aa, Artificial Sequence
  Description of Artificial Sequence: Synthetic polypeptide
MALPVTALLLPLALLLHAARPQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPA

SEQ ID NO: 576 - DNA, 732 bp, Artificial Sequence
  Description of Artificial Sequence: Synthetic polynucleotide
caagtccaactgcagcagtcaggagcggaagtgaagaaaccaggagcgtcagtcaaagtgtcgtgcaaggctagcggctacaccttcaccggctactacatgcactgggttcgacaggctccagggcagggtctggagtggatgggccgcatcaacccgaattccggtgggactaactacgcccagaagttccagggaagagtgaccatgactagggacacgtcgatcagcactgcgtacatggaactgagccgcctgcggtccgaggatactgccgtctactactgcgcacgcggaaggtactatggaatggacgtgtggggccaagggactatggtgactgtgagctcgggagggggaggctccggtggcgggggatcaggaggaggaggatcagggggaggaggttccgaaattgtcctcacccagagcccggcaaccctctcactttccccgggagagcgcgcaaccatctcttgccgggctagccaatccgtgtcgtccaatttcgcctggtaccagcaacggccgggacaagcccctagactcctgatctacgacgccagcaacagagcgactggaattcctccacgcttttcgggatcaggctccggtaccgacttcaccctgactatctcgtcgctcgaacccgaggatttcgccgcctactactgtcatcagcggtcgaactggttgtatacgtttggccagggcaccaaggtggatatcaag

SEQ ID NO: 577 - DNA, 1464 bp, Artificial Sequence
  Description of Artificial Sequence: Synthetic polynucleotide
atggccctccctgtcaccgccctgctgcttccgctggctcttctgctccacgccgctcggccccaagtccaactgcagcagtcaggagcggaagtgaagaaaccaggagcgtcagtcaaagtgtcgtgcaaggctagcggctacaccttcaccggctactacatgcactgggttcgacaggctccagggcagggtctggagtggatgggccgcatcaacccgaattccggtgggactaactacgcccagaagttccagggaagagtgaccatgactagggacacgtcgatcagcactgcgtacatggaactgagccgcctgcggtccgaggatactgccgtctactactgcgcacgcggaaggtactatggaatggacgtgtggggccaagggactatggtgactgtgagctcgggagggggaggctccggtggcgggggatcaggaggaggaggatcagggggaggaggttccgaaattgtcctcacccagagcccggcaaccctctcactttccccgggagagcgcgcaaccatctcttgccgggctagccaatccgtgtcgtccaatttcgcctggtaccagcaacggccgggacaagcccctagactcctgatctacgacgccagcaacagagcgactggaattcctccacgcttttcgggatcaggctccggtaccgacttcaccctgactatctcgtcgctcgaacccgaggatttcgccgcctactactgtcatcagcggtcgaactggttgtatacgtttggccagggcaccaaggtggatatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 578 - DNA, 759 bp, Artificial Sequence
  Description of Artificial Sequence: Synthetic polynucleotide
caagtccaactcgtccagtcaggagcagaagtcaagaaaccaggtgctagcgtgaaagtgtcgtgcaaggcgtcgggatacactttcaccggatactacatgcactgggtccgccaggcccccggacaaggactggaatggatgggctggatcaacccgaatagcgggggaactaattacgcccagaagtttcagggacgagtgaccatgacccgcgatacctctatctcgaccgcctacatggagctctccagactgcgctccgacgatactgcagtgtactactgcgcccgggacctgaggcggactgtggttactcctcgcgcctattatggcatggacgtgtggggccaaggaactactgtgactgtgagctcgggaggcggtgggtcaggcggaggagggtcgggcggtggtggctcgggagggggaggaagcgacattcaacttacgcagagcccgtcaaccctgtcagcgtcagtgggagatcgggtgaccatcacgtgtcaggccagccaggatatctccaactcgctcaactggtaccagcaaaaggcgggtaaagctccgaagctgctgatctacgacgcttccaccctcgagactggagtcccatccagattttccgggtcaggaagcggcaccgatttctccttcaccatttcgtccttgcaaccggaggacatcgcaacctactactgccagcagcatgacaacttgcctctgacgttcgggcagggcaccaaggtggaaatcaag

SEQ ID NO: 579 - DNA, 1491 bp, Artificial Sequence
  Description of Artificial Sequence: Synthetic polynucleotide
atggccctccctgtcaccgccctgctgcttccgctggctcttctgctccacgccgctcggccccaagtccaactcgtccagtcaggagcagaagtcaagaaaccaggtgctagcgtgaaagtgtcgtgcaaggcgtcgggatacactttcaccggatactacatgcactgggtccgccaggcccccggacaaggactggaatggatgggctggatcaacccgaatagcgggggaactaattacgcccagaagtttcagggacgagtgaccatgacccgcgatacctctatctcgaccgcctacatggagctctccagactgcgctccgacgatactgcagtgtactactgcgcccgggacctgaggcggactgtggttactcctcgcgcctattatggcatggacgtgtggggccaaggaactactgtgactgtgagctcgggaggcggtgggtcaggcggaggagggtcgggcggtggtggctcgggagggggaggaagcgacattcaacttacgcagagcccgtcaaccctgtcagcgtcagtgggagatcgggtgaccatcacgtgtcaggccagccaggatatctccaactcgctcaactggtaccagcaaaaggcgggtaaagctccgaagctgctgatctacgacgcttccaccctcgagactggagtcccatccagattttccgggtcaggaagcggcaccgatttctccttcaccatttcgtccttgcaaccggaggacatcgcaacctactactgccagcagcatgacaacttgcctctgacgttcgggcagggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 580 - DNA, 738 bp, Artificial Sequence
  Description of Artificial Sequence: Synthetic polynucleotide
caagtccaactcgtccaatcaggagcggaagtcaaaaagcccggagctccagtgaaagtgtcatgcaaggcctccggctacaccttcaccggttactatatgcactgggtgcggcaggccccgggccaggggttggaatggatgggatggatcaatccaaactcgggtgggactaactacgcccagaagttccaaggacgggtgaccatgactagggacacctcgatctccaccgcatacatggagcttagcagactccgctccgacgataccgcagtctactattgcgcgcggggagagtgggacggatcgtactactacgattactggggccagggaactctggtgactgtttcctcgggtggaggaggttcaggcggaggcggctcgggcgggggaggatctggaggaggagggtccgacattgtgctgacccaaactccttcgtccctgtcggccagcgtgggcgaccgcgtgacgattacgtgcagagctagccaatccatcaatacttacctcaactggtaccagcataagccggggaaagcaccaaagctgctgatctacgccgcctcatccttgcagagcggtgtgccttcacgctttagcggatcgggatcgggaacggatttcaccctgactatcagctccctccagccggaggattttgcgacctactactgtcagcagagcttctcaccgctgactttcggcggcgggaccaagctggaaatcaag

SEQ ID NO: 581 - DNA, 1470 bp, Artificial Sequence
  Description of Artificial Sequence: Synthetic polynucleotide
atggccctccctgtcaccgccctgctgcttccgctggctcttctgctccacgccgctcggccccaagtccaactcgtccaatcaggagcggaagtcaaaaagcccggagctccagtgaaagtgtcatgcaaggcctccggctacaccttcaccggttactatatgcactgggtgcggcaggccccgggccaggggttggaatggatgggatggatcaatccaaactcgggtgggactaactacgcccagaagttccaaggacgggtgaccatgactagggacacctcgatctccaccgcatacatggagcttagcagactccgctccgacgataccgcagtctactattgcgcgcggggagagtgggacggatcgtactactacgattactggggccagggaactctggtgactgtttcctcgggtggaggaggttcaggcggaggcggctcgggcgggggaggatctggaggaggagggtccgacattgtgctgacccaaactccttcgtccctgtcggccagcgtgggcgaccgcgtgacgattacgtgcagagctagccaatccatcaatacttacctcaactggtaccagcataagccggggaaagcaccaaagctgctgatctacgccgcctcatccttgcagagcggtgtgccttcacgctttagcggatcgggatcgggaacggatttcaccctgactatcagctccctccagccggaggattttgcgacctactactgtcagcagagcttctcaccgctgactttcggcggcgggaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 582 - DNA, 726 bp, Artificial Sequence
  Description of Artificial Sequence: Synthetic polynucleotide
caagtgcaactcgttgaatcaggtggaggtttggtgcaacccggaggatctctcagactgtcgtgtgcggcgtccgggttcaccttttcgtcctactggatgcactgggtgcgccaggtgccgggaaaaggactggtgtgggtgtccagaatcaacaccgacgggtcaacgactacctacgcagatagcgtggaaggtcggttcaccatttcgcgggacaacgctaaaaacactctgtaccttcagatgaattcactgcgcgatgacgacaccgcagtctactactgcgtcggtggacactgggcggtctggggacagggaactacggtgactgtgtccagcggcgggggaggaagcggcggaggggggagcggaggcggaggatcaggaggaggcggctccgatatccagatgacccagtcgccatcgaccctctccgctagcgtgggggatagggtcactatcacttgccgagccagccaatccattagcgaccggcttgcctggtaccaacagaaacctggaaaggccccgaagctgctcatctacaaggcctcgtcactggagtcgggagtcccgtcccgcttttccggctcgggctcaggcaccgagttcactctgaccatctcgagcctgcagccggacgatttcgccgtgtattactgccagcaatacggacatctcccaatgtacacgttcggtcagggcaccaaggtcgaaatcaag

SEQ ID NO: 583 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcaactcgttgaatcaggtggaggtttggtgcaacccggaggatctctcagactgtcgtgtgcggcgtccgggttcaccttttcgtcctactggatgcactgggtgcgccaggtgccgggaaaaggactggtgtgggtgtccagaatcaacaccgacgggtcaacgactacctacgcagatagcgtggaaggtcggttcaccatttcgcgggacaacgctaaaaacactctgtaccttcagatgaattcactgcgcgatgacgacaccgcagtctactactgcgtcggtggacactgggcggtctggggacagggaactacggtgactgtgtccagcggcgggggaggaagcggcggaggggggagcggaggcggaggatcaggaggaggcggctccgatatccagatgacccagtcgccatcgaccctctccgctagcgtgggggatagggtcactatcacttgccgagccagccaatccattagcgaccggcttgcctggtaccaacagaaacctggaaaggccccgaagctgctcatctacaaggcctcgtcactggagtcgggagtcccgtcccgcttttccggctcgggctcaggcaccgagttcactctgaccatctcgagcctgcagccggacgatttcgccgtgtattactgccagcaatacggacatctcccaatgtacacgttcggtcagggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 584 - DNA, 723 bp, Artificial Sequence
  Description of Artificial Sequence: Synthetic polynucleotide
caagtccaactcgttcaatcaggcgcagaagtcgaaaagcccggagcatcagtcaaagtctcttgcaaggcttccggctacaccttcacggactactacatgcactgggtgcgccaggctccaggccagggactggagtggatgggatggatcaacccgaattccgggggaactaactacgcccagaagtttcagggccgggtgactatgactcgcgatacctcgatctcgactgcgtacatggagctcagccgcctccggtcggacgataccgccgtgtactattgtgcgtcgggatgggacttcgactactgggggcagggcactctggtcactgtgtcaagcggaggaggtggatcaggtggaggtggaagcgggggaggaggttccggcggcggaggatcagatatcgtgatgacgcaatcgccttcctcgttgtccgcatccgtgggagacagggtgaccattacttgcagagcgtcccagtccattcggtactacctgtcgtggtaccagcagaagccggggaaagccccaaaactgcttatctatactgcctcgatcctccaaaacggcgtgccatcaagattcagcggttcgggcagcgggaccgactttaccctgactatcagcagcctgcagccggaagatttcgccacgtactactgcctgcaaacctacaccaccccggacttcggacctggaaccaaggtggagatcaag

SEQ ID NO: 585 - DNA, 1455 bp, Artificial Sequence
  Description of Artificial Sequence: Synthetic polynucleotide
atggccctccctgtcaccgccctgctgcttccgctggctcttctgctccacgccgctcggccccaagtccaactcgttcaatcaggcgcagaagtcgaaaagcccggagcatcagtcaaagtctcttgcaaggcttccggctacaccttcacggactactacatgcactgggtgcgccaggctccaggccagggactggagtggatgggatggatcaacccgaattccgggggaactaactacgcccagaagtttcagggccgggtgactatgactcgcgatacctcgatctcgactgcgtacatggagctcagccgcctccggtcggacgataccgccgtgtactattgtgcgtcgggatgggacttcgactactgggggcagggcactctggtcactgtgtcaagcggaggaggtggatcaggtggaggtggaagcgggggaggaggttccggcggcggaggatcagatatcgtgatgacgcaatcgccttcctcgttgtccgcatccgtgggagacagggtgaccattacttgcagagcgtcccagtccattcggtactacctgtcgtggtaccagcagaagccggggaaagccccaaaactgcttatctatactgcctcgatcctccaaaacggcgtgccatcaagattcagcggttcgggcagcgggaccgactttaccctgactatcagcagcctgcagccggaagatttcgccacgtactactgcctgcaaacctacaccaccccggacttcggacctggaaccaaggtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 586 - DNA, 759 bp, Artificial Sequence
  Description of Artificial Sequence: Synthetic polynucleotide
caagtgcaactcgtccagtcaggtgcagaagtgaagaaacccggagcgtcagtcaaagtgtcatgcaaggcgtcaggctacaccttcaccagctactacatgcactgggtgcggcaggccccaggccaaggcttggagtggatgggaatcattaacccgtcaggaggctccacctcctacgcccagaagtttcagggaagagtgacgatgactcgggatacgtcgacctcgaccgtgtacatggaactgagctcgctgcgctccgaggacactgctgtgtactactgcgcacggtacagactcattgccgtggcaggagactactactactatggcatggacgtctgggggcagggcactatggtcactgtgtcgtccggcggaggaggctcgggtggaggaggtagcggaggagggggaagcggaggggggggctccgatatccagatgactcagtcgccttcctccgtgtcggcctcggttggagatcgcgtcaccatcacttgtcgagcttcccaaggagtcggtaggtggctggcgtggtaccagcaaaagccgggaactgccccgaagctcctgatctacgcggctagcaccctgcagtcgggagtgccatcccgcttcagcggatctgggtcaggtaccgacttcacccttacgatcaacaatctccagccggaggactttgccacctattactgccaacaggccaacagcttccctctgactttcggagggggcactcgcctggaaatcaag

SEQ ID NO: 587 - DNA, 1491 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtcaggtgcagaagtgaagaaacccggagcgtcagtcaaagtgtcatgcaaggcgtcaggctacaccttcaccagctactacatgcactgggtgcggcaggccccaggccaaggcttggagtggatgggaatcattaacccgtcaggaggctccacctcctacgcccagaagtttcagggaagagtgacgatgactcgggatacgtcgacctcgaccgtgtacatggaactgagctcgctgcgctccgaggacactgctgtgtactactgcgcacggtacagactcattgccgtggcaggagactactactactatggcatggacgtctgggggcagggcactatggtcactgtgtcgtccggcggaggaggctcgggtggaggaggtagcggaggagggggaagcggaggggggggctccgatatccagatgactcagtcgccttcctccgtgtcggcctcggttggagatcgcgtcaccatcacttgtcgagcttcccaaggagtcggtaggtggctggcgtggtaccagcaaaagccgggaactgccccgaagctcctgatctacgcggctagcaccctgcagtcgggagtgccatcccgcttcagcggatctgggtcaggtaccgacttcacccttacgatcaacaatctccagccggaggactttgccacctattactgccaacaggccaacagcttccctctgactttcggagggggcactcgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 588 - DNA, 750 bp, Artificial Sequence
  Description of Artificial Sequence: Synthetic polynucleotide
caagtgcaattggttcaatcaggaggaggagtggtgcaacctggaagatctctcagactgtcgtgtgcggcatcgggattcactttctcatcatacgcaatgcactgggtccgccaggccccgggcaaaggcttggaatgggtggcggtcatttcatacgacggctcgaacaagtactacgctgacagcgtgaagggacgctttactatttcccgggacaattcgaagaacactctgtacctccagatgaactcccttagggctgaggacaccgccgtctactactgcgcacgctggaaagtgtcgtccagctccccagcttttgactactggggacagggaacccttgtgaccgtgtcgtccggtggagggggaagcggcggagggggatcaggtggcggcggatcgggaggcgggggatcagaaatcgtgctgactcagtccccggccacgctgtctctcagcccgggagagagagcgatcctgtcctgccgcgcctcgcagagcgtgtacactaagtacctggggtggtaccagcagaaaccgggtcaagcgcctcggctgctgatctacgatgcctccacccgggccaccggaatccccgatcggttctccggcagcggctcgggaactgatttcacgctgaccatcaatcgcctggagccggaagatttcgccgtctattactgccagcattacggcgggagcccactcatcaccttcggtcaaggaacccgactcgaaatcaag

SEQ ID NO: 589 - DNA, 1482 bp, Artificial Sequence
  Description of Artificial Sequence: Synthetic polynucleotide
atggccctccctgtcaccgccctgctgcttccgctggctcttctgctccacgccgctcggccccaagtgcaattggttcaatcaggaggaggagtggtgcaacctggaagatctctcagactgtcgtgtgcggcatcgggattcactttctcatcatacgcaatgcactgggtccgccaggccccgggcaaaggcttggaatgggtggcggtcatttcatacgacggctcgaacaagtactacgctgacagcgtgaagggacgctttactatttcccgggacaattcgaagaacactctgtacctccagatgaactcccttagggctgaggacaccgccgtctactactgcgcacgctggaaagtgtcgtccagctccccagcttttgactactggggacagggaacccttgtgaccgtgtcgtccggtggagggggaagcggcggagggggatcaggtggcggcggatcgggaggcgggggatcagaaatcgtgctgactcagtccccggccacgctgtctctcagcccgggagagagagcgatcctgtcctgccgcgcctcgcagagcgtgtacactaagtacctggggtggtaccagcagaaaccgggtcaagcgcctcggctgctgatctacgatgcctccacccgggccaccggaatccccgatcggttctccggcagcggctcgggaactgatttcacgctgaccatcaatcgcctggagccggaagatttcgccgtctattactgccagcattacggcgggagcccactcatcaccttcggtcaaggaacccgactcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 590 - DNA, 738 bp, Artificial Sequence
  Description of Artificial Sequence: Synthetic polynucleotide
caagtccaactccagcagtcaggtgcagaagtcaaaaagccaggagcatccgtgaaggtttcgtgcaagacttccggctacccttttaccgggtactccctccattgggtgagacaagcaccgggccagggactggagtggatgggatggatcaacccaaattcgggcggcaccaactatgcgcagaagttccagggacgggtgaccatgactcgcgacacttcgatctccactgcctacatggagctgtcccgcttgagatctgacgacacggccgtctactactgcgcccgggatcactacggaggtaattcgctgttctactgggggcagggaacccttgtgactgtgtcctcgggtggtggagggtcaggaggcggaggctcagggggaggaggtagcggaggaggcggatcagacatccaactgacccagtcaccatcctccatctcggctagcgtcggagacaccgtgtcgattacttgtagggcctcccaagactcagggacgtggctggcgtggtatcagcaaaaaccgggcaaagctccgaacctgttgatgtacgacgccagcaccctcgaagatggagtgcctagccgcttcagcggaagcgcctcgggcactgaattcacgctgactgtgaatcggctccagccggaggattcggcgacctactactgccagcagtacaacagctaccccctgacctttggaggcgggaccaaggtggatatcaag

SEQ ID NO: 591 - DNA, 1470 bp, Artificial Sequence
  Description of Artificial Sequence: Synthetic polynucleotide
atggccctccctgtcaccgccctgctgcttccgctggctcttctgctccacgccgctcggccccaagtccaactccagcagtcaggtgcagaagtcaaaaagccaggagcatccgtgaaggtttcgtgcaagacttccggctacccttttaccgggtactccctccattgggtgagacaagcaccgggccagggactggagtggatgggatggatcaacccaaattcgggcggcaccaactatgcgcagaagttccagggacgggtgaccatgactcgcgacacttcgatctccactgcctacatggagctgtcccgcttgagatctgacgacacggccgtctactactgcgcccgggatcactacggaggtaattcgctgttctactgggggcagggaacccttgtgactgtgtcctcgggtggtggagggtcaggaggcggaggctcagggggaggaggtagcggaggaggcggatcagacatccaactgacccagtcaccatcctccatctcggctagcgtcggagacaccgtgtcgattacttgtagggcctcccaagactcagggacgtggctggcgtggtatcagcaaaaaccgggcaaagctccgaacctgttgatgtacgacgccagcaccctcgaagatggagtgcctagccgcttcagcggaagcgcctcgggcactgaattcacgctgactgtgaatcggctccagccggaggattcggcgacctactactgccagcagtacaacagctaccccctgacctttggaggcgggaccaaggtggatatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 592 - DNA, 744 bp, Artificial Sequence
  Description of Artificial Sequence: Synthetic polynucleotide
caagtgcaactcgtccagtcaggtgcagaagtgaagaaaccaggagcgtccgtcgaagtgtcgtgtaaggcgtccggctacactttcacctcgtactacatgcactgggtgcggcaggccccgggacaaggcctcgaatggatgggaatcatcaacccgagcggaggctcgactggttacgcccagaagttccagggaagggtgacgatgacccgcgatacctcgacttcgaccgttcatatggagctctcgtccctgcggagcgaggacactgctgtctactattgcgcgcggggaggatactctagctcctccgatgcatttgacatttggggccagggaactatggtgaccgtgtcatcaggcggaggtggatcaggaggaggagggtcgggagggggaggcagcggcgggggtgggtcggacattcagatgacgcagtcccctcctagcctgagcgcctcggtgggtgacagagtgaccatcacttgcagagcctcgcaagacatctcctccgcattggcttggtaccagcaaaagccgggcactccgccgaaactgctcatctacgatgcctcctcactggagtcaggagtcccatctcgcttctcggggtcaggaagcggcaccgattttacccttaccatctccagcctgcagcccgaggacttcgccacgtactactgccaacagttcagctcctacccactgaccttcgggggcggaactcgcctggaaatcaag

SEQ ID NO: 593 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtcaggtgcagaagtgaagaaaccaggagcgtccgtcgaagtgtcgtgtaaggcgtccggctacactttcacctcgtactacatgcactgggtgcggcaggccccgggacaaggcctcgaatggatgggaatcatcaacccgagcggaggctcgactggttacgcccagaagttccagggaagggtgacgatgacccgcgatacctcgacttcgaccgttcatatggagctctcgtccctgcggagcgaggacactgctgtctactattgcgcgcggggaggatactctagctcctccgatgcatttgacatttggggccagggaactatggtgaccgtgtcatcaggcggaggtggatcaggaggaggagggtcgggagggggaggcagcggcgggggtgggtcggacattcagatgacgcagtcccctcctagcctgagcgcctcggtgggtgacagagtgaccatcacttgcagagcctcgcaagacatctcctccgcattggcttggtaccagcaaaagccgggcactccgccgaaactgctcatctacgatgcctcctcactggagtcaggagtcccatctcgcttctcggggtcaggaagcggcaccgattttacccttaccatctccagcctgcagcccgaggacttcgccacgtactactgccaacagttcagctcctacccactgaccttcgggggcggaactcgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 594 - DNA, 765 bp, Artificial Sequence
  Description of Artificial Sequence: Synthetic polynucleotide
caagtgcaactcgtccagagcggagcagaagtcaagaagccaggagcgtcagtgaaagtgtcatgcaaggccagcggctatacctttacttcgtatgggatctcctgggtgcggcaggcaccgggccaaggactggagtggatgggatggatctcagcctacaacggtaacaccaactacgcccagaagctgcaaggacgcgtgaccatgactactgatacgagcacctccactgcctacatggaattgcggtcccttcggtcggacgatactgctgtgtactactgcgcaagagtcgccggagggatctactactactacggcatggacgtctggggacagggaaccaccattacggtgtcgagcggagggggaggctcggggggaggaggaagcggaggtggcggctccgggggcggcggatcggacattgtgatgacccagactcctgactccctggctgtttcgttgggagagcgcgcgactatctcgtgtaagtccagccactcagtcctgtacaatcgcaataacaagaactacctcgcgtggtaccagcaaaaaccgggtcagccgcctaaactcctgttctactgggcctccaccagaaagagcggggtgccagatcgattctctggatcaggatcaggtaccgactttacgctgaccatctcgtccctgcagccggaggatttcgcgacttacttctgccagcagactcagactttccccctcaccttcggtcaaggcaccaggctggaaatcaat

SEQ ID NO: 595 - DNA, 1497 bp, Artificial Sequence
  Description of Artificial Sequence: Synthetic polynucleotide
atggccctccctgtcaccgccctgctgcttccgctggctcttctgctccacgccgctcggccccaagtgcaactcgtccagagcggagcagaagtcaagaagccaggagcgtcagtgaaagtgtcatgcaaggccagcggctatacctttacttcgtatgggatctcctgggtgcggcaggcaccgggccaaggactggagtggatgggatggatctcagcctacaacggtaacaccaactacgcccagaagctgcaaggacgcgtgaccatgactactgatacgagcacctccactgcctacatggaattgcggtcccttcggtcggacgatactgctgtgtactactgcgcaagagtcgccggagggatctactactactacggcatggacgtctggggacagggaaccaccattacggtgtcgagcggagggggaggctcggggggaggaggaagcggaggtggcggctccgggggcggcggatcggacattgtgatgacccagactcctgactccctggctgtttcgttgggagagcgcgcgactatctcgtgtaagtccagccactcagtcctgtacaatcgcaataacaagaactacctcgcgtggtaccagcaaaaaccgggtcagccgcctaaactcctgttctactgggcctccaccagaaagagcggggtgccagatcgattctctggatcaggatcaggtaccgactttacgctgaccatctcgtccctgcagccggaggatttcgcgacttacttctgccagcagactcagactttccccctcaccttcggtcaaggcaccaggctggaaatcaataccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 596 - DNA, 723 bp, Artificial Sequence
  Description of Artificial Sequence: Synthetic polynucleotide
caagtccaattgcagcagagcggagcagaagtgaagaagccaggagcgtcagtcaaagtgtcgtgtaaggcgtcaggatacaccttcacgggatactacatgcactgggtgcgccaggccccgggccaaggactcgagtggatgggctggatcaaccctaactctggaggcaccaactacgcccagaatttccaaggcagagtgaccatgacccgggacacctccatctcgactgcctatatggaactgcggcggctgcgctcggacgatactgctgtgtattactgcgccagcggctgggactttgactactggggacagggtactctggtgactgtttcctcgggaggaggcggatcgggtggaggaggtagcgggggaggggggtcgggaggcggaggcagcgatattcgcatgactcaatcgccgtcctccctgagcgctagcgtgggagatcgagtcaccatcacttgcagagcgtcacagtcgattcgctactacctgtcctggtaccagcagaaaccgggaaaggcaccaaagcttctgatctacacggcctccatcctgcaaaatggtgtcccatcaaggttctccgggtcagggagcggcactgacttcactctcaccatctcctcactccagcccgaggactttgcaacctactactgcctccagacgtacaccaccccggatttcggtcctggaaccaaggtggaaatcaaa

SEQ ID NO: 597 - DNA, 1455 bp, Artificial Sequence
  Description of Artificial Sequence: Synthetic polynucleotide
atggccctccctgtcaccgccctgctgcttccgctggctcttctgctccacgccgctcggccccaagtccaattgcagcagagcggagcagaagtgaagaagccaggagcgtcagtcaaagtgtcgtgtaaggcgtcaggatacaccttcacgggatactacatgcactgggtgcgccaggccccgggccaaggactcgagtggatgggctggatcaaccctaactctggaggcaccaactacgcccagaatttccaaggcagagtgaccatgacccgggacacctccatctcgactgcctatatggaactgcggcggctgcgctcggacgatactgctgtgtattactgcgccagcggctgggactttgactactggggacagggtactctggtgactgtttcctcgggaggaggcggatcgggtggaggaggtagcgggggaggggggtcgggaggcggaggcagcgatattcgcatgactcaatcgccgtcctccctgagcgctagcgtgggagatcgagtcaccatcacttgcagagcgtcacagtcgattcgctactacctgtcctggtaccagcagaaaccgggaaaggcaccaaagcttctgatctacacggcctccatcctgcaaaatggtgtcccatcaaggttctccgggtcagggagcggcactgacttcactctcaccatctcctcactccagcccgaggactttgcaacctactactgcctccagacgtacaccaccccggatttcggtcctggaaccaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 598 - DNA, 738 bp, Artificial Sequence
  Description of Artificial Sequence: Synthetic polynucleotide
caagtccaactcgtccaaagcggagcagaagtcaaaaagccaggagcgtcggtgaaagtgtcttgcaaagccagcggctacaccttcacgggttactacatgcactgggtgcgccaggcgccgggccaggggctggagtggatgggccggattaaccctaacagcgggggaactaattacgctcagaagttccagggtagagtcaccatgactacggacacttccacttccaccgcctatatggaactgcgctccctccgctcagatgatactgccgtgtattactgcgcgcggactaccacgtcatacgcatttgacatctggggccagggaactatggtgaccgtgagctcgggcggaggcggttcagggggaggaggaagcggaggaggaggatcgggaggaggtggctccgatatccagctgactcagtccccgagcaccctgtcggcgtcggtgggggacagggttaccatcacctgtagagcttcccaatccatttcgacttggctggcctggtaccagcaaaagccgggaaaggcccctaatttgcttatctacaaggcatcgaccctcgaaagcggtgtgccctcccggttttcgggatcaggatcagggaccgagttcaccctgaccatctcatccctccagccggacgacttcgccacttactactgccagcagtacaacacctactcgccatacactttcggccaaggcaccaagctggagatcaag

SEQ ID NO: 599 - DNA, 1470 bp, Artificial Sequence
  Description of Artificial Sequence: Synthetic polynucleotide
atggccctccctgtcaccgccctgctgcttccgctggctcttctgctccacgccgctcggccccaagtccaactcgtccaaagcggagcagaagtcaaaaagccaggagcgtcggtgaaagtgtcttgcaaagccagcggctacaccttcacgggttactacatgcactgggtgcgccaggcgccgggccaggggctggagtggatgggccggattaaccctaacagcgggggaactaattacgctcagaagttccagggtagagtcaccatgactacggacacttccacttccaccgcctatatggaactgcgctccctccgctcagatgatactgccgtgtattactgcgcgcggactaccacgtcatacgcatttgacatctggggccagggaactatggtgaccgtgagctcgggcggaggcggttcagggggaggaggaagcggaggaggaggatcgggaggaggtggctccgatatccagctgactcagtccccgagcaccctgtcggcgtcggtgggggacagggttaccatcacctgtagagcttcccaatccatttcgacttggctggcctggtaccagcaaaagccgggaaaggcccctaatttgcttatctacaaggcatcgaccctcgaaagcggtgtgccctcccggttttcgggatcaggatcagggaccgagttcaccctgaccatctcatccctccagccggacgacttcgccacttactactgccagcagtacaacacctactcgccatacactttcggccaaggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 600 - DNA, 747 bp, Artificial Sequence
  Description of Artificial Sequence: Synthetic polynucleotide
caagttcaactcgtgcaatcaggtggaggactcgtcaaacccggaggatcattgagactgtcatgcgaagcgagcggttttatcttctccgattactatatgggatggattcggcaggccccgggaaagggactcgaatgggtgtcatacatcggaaggtcaggctcgtccatgtactacgcagactcggtgaaaggcagattcacctttagccgggacaacgccaagaattccctctacttgcagatgaacagcctgcgagccgaggatactgctgtctactactgtgccgcgtcgccggtggtggcagctactgaagatttccagcactggggacagggaactctggtcacggtgtcgagcggtgggggcggaagcggaggcggaggatcgggcggcggaggttcgggggggggagggtctgacatcgtgatgacccaaaccccagccaccctgagcctctcccctggagagcgcgcgactctttcgtgccgcgcttcccagtcagtgaccagcaattacttggcttggtaccaacagaagccgggacaggcgccacggctgctgctttttggtgccagcactcgcgccaccggaatcccggatcgcttctcgggctcagggtccgggacggacttcaccctgactatcaaccggctggaacctgaggacttcgcgatgtactactgccagcagtacggctccgcaccagtcactttcggacaaggcaccaagctggagatcaag

SEQ ID NO: 601 - DNA, 1479 bp, Artificial Sequence
  Description of Artificial Sequence: Synthetic polynucleotide
atggccctccctgtcaccgccctgctgcttccgctggctcttctgctccacgccgctcggccccaagttcaactcgtgcaatcaggtggaggactcgtcaaacccggaggatcattgagactgtcatgcgaagcgagcggttttatcttctccgattactatatgggatggattcggcaggccccgggaaagggactcgaatgggtgtcatacatcggaaggtcaggctcgtccatgtactacgcagactcggtgaaaggcagattcacctttagccgggacaacgccaagaattccctctacttgcagatgaacagcctgcgagccgaggatactgctgtctactactgtgccgcgtcgccggtggtggcagctactgaagatttccagcactggggacagggaactctggtcacggtgtcgagcggtgggggcggaagcggaggcggaggatcgggcggcggaggttcgggggggggagggtctgacatcgtgatgacccaaaccccagccaccctgagcctctcccctggagagcgcgcgactctttcgtgccgcgcttcccagtcagtgaccagcaattacttggcttggtaccaacagaagccgggacaggcgccacggctgctgctttttggtgccagcactcgcgccaccggaatcccggatcgcttctcgggctcagggtccgggacggacttcaccctgactatcaaccggctggaacctgaggacttcgcgatgtactactgccagcagtacggctccgcaccagtcactttcggacaaggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 602 - DNA, 747 bp, Artificial Sequence
  Description of Artificial Sequence: Synthetic polynucleotide
caagtccaactcgtccagtcgggagcagaagttagagcaccaggagcgtcagtgaaaatctcatgcaaggcctcgggcttcacgttccgcggatactacatccactgggtgcgccaagccccgggtcagggattggagtggatgggaatcattaacccatcaggagggagccgggcttacgcgcagaagttccagggacgcgtcactatgacccgagatacttccacctcgactgtgtacatggaactctcgtccctgaggtccgacgacactgcgatgtattactgtgctcggactgccagctgcggtggggactgttactacctcgattactggggccagggaactctggtgaccgtgtccagcggaggtggcgggtcagggggtggcggaagcggaggcggcggttcaggcggaggaggctcggacatccaaatgacgcaatcgccgcctaccctgagcgcttccgtgggagatcgggtgaccattacttgcagagcatccgagaacgtcaatatctggctggcctggtaccaacagaagccggggaaggcccctaaactgctgatctacaagtcgagcagccttgcctctggagtgccctcccgcttctcgggctcgggatcaggagcggaattcaccctcaccatctcctccctgcagccagatgactttgccacctactactgccagcagtaccagagctatccgttgacctttgggggaggcactaaagtggacatcaag

SEQ ID NO: 603 - DNA, 1479 bp, Artificial Sequence
  Description of Artificial Sequence: Synthetic polynucleotide
atggccctccctgtcaccgccctgctgcttccgctggctcttctgctccacgccgctcggccccaagtccaactcgtccagtcgggagcagaagttagagcaccaggagcgtcagtgaaaatctcatgcaaggcctcgggcttcacgttccgcggatactacatccactgggtgcgccaagccccgggtcagggattggagtggatgggaatcattaacccatcaggagggagccgggcttacgcgcagaagttccagggacgcgtcactatgacccgagatacttccacctcgactgtgtacatggaactctcgtccctgaggtccgacgacactgcgatgtattactgtgctcggactgccagctgcggtggggactgttactacctcgattactggggccagggaactctggtgaccgtgtccagcggaggtggcgggtcagggggtggcggaagcggaggcggcggttcaggcggaggaggctcggacatccaaatgacgcaatcgccgcctaccctgagcgcttccgtgggagatcgggtgaccattacttgcagagcatccgagaacgtcaatatctggctggcctggtaccaacagaagccggggaaggcccctaaactgctgatctacaagtcgagcagccttgcctctggagtgccctcccgcttctcgggctcgggatcaggagcggaattcaccctcaccatctcctccctgcagccagatgactttgccacctactactgccagcagtaccagagctatccgttgacctttgggggaggcactaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 604 - DNA, 732 bp, Artificial Sequence
  Description of Artificial Sequence: Synthetic polynucleotide
caagttcaactcgttcaatcaggtggaggactcgtgcaaccaggaagatcactcagactcagctgcgccgcgtcgggattcactttcgatgactacgcaatgcactgggtgcggcaggccccgggcaaaggactggaatgggtgagcggaattagctggaactcggggtccatcgggtacgccgactcggtgaagggacgctttacgatctcccgggacaatgccaagaactccctgtatttgcagatgaactccttgagggctgaggacaccgccgtgtactactgcgctaaagatggatcatcgtcctggtcctggggatacttcgattactggggccagggcactctggtgaccgtgtcgtcaggcggtggagggtcgggcggaggaggtagcggaggcggagggagcagctctgaactgacccaagacccggcggtgtcggtcgcccttggtcagactgtgcggactacctgtcagggggacgcgctgcgctcgtactacgcttcatggtaccagcagaagcccggacaggcacctatgctggtcatctacggaaagaataaccgcccatccggcatcccggatcgcttctcgggttcggacagcggcgacaccgcatccctgacgatcactggagcgcaggccgaggatgaagccgactactactgcaattcccgagattcaagcggctaccctgtgtttgggaccggaactaaggtcaccgtcctg

SEQ ID NO: 605 - DNA, 1464 bp, Artificial Sequence
  Description of Artificial Sequence: Synthetic polynucleotide
atggccctccctgtcaccgccctgctgcttccgctggctcttctgctccacgccgctcggccccaagttcaactcgttcaatcaggtggaggactcgtgcaaccaggaagatcactcagactcagctgcgccgcgtcgggattcactttcgatgactacgcaatgcactgggtgcggcaggccccgggcaaaggactggaatgggtgagcggaattagctggaactcggggtccatcgggtacgccgactcggtgaagggacgctttacgatctcccgggacaatgccaagaactccctgtatttgcagatgaactccttgagggctgaggacaccgccgtgtactactgcgctaaagatggatcatcgtcctggtcctggggatacttcgattactggggccagggcactctggtgaccgtgtcgtcaggcggtggagggtcgggcggaggaggtagcggaggcggagggagcagctctgaactgacccaagacccggcggtgtcggtcgcccttggtcagactgtgcggactacctgtcagggggacgcgctgcgctcgtactacgcttcatggtaccagcagaagcccggacaggcacctatgctggtcatctacggaaagaataaccgcccatccggcatcccggatcgcttctcgggttcggacagcggcgacaccgcatccctgacgatcactggagcgcaggccgaggatgaagccgactactactgcaattcccgagattcaagcggctaccctgtgtttgggaccggaactaaggtcaccgtcctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 606 - DNA, 738 bp, Artificial Sequence
  Description of Artificial Sequence: Synthetic polynucleotide
gaagtgcaactcgtggaatctggtggaggacttgtgcaacctggaagatcgttgagactctcatgtgctgcctccgggttcacctttgacgactacgccatgcactgggtgcgccaggcaccaggaaagggtctggagtgggtttcgggtatctcgtggaactccgggagcactggctacgctgattcggtgaaaggccggtttaccatctcccgagacaatgcgaagaattccctctatctgcagatgaacagcctccgggccgaggatactgccctgtactactgcgccaaggatagctcatcatggtacggaggtggatcggctttcgatatctggggccagggcacgatggtcaccgtgtcctcggggggcggaggctccgggggaggaggtagcggaggaggaggatcgagctcagagttgactcaagaacccgcagtgtccgtggcactgggccaaaccgtcaggatcacttgccagggagacagcctgaggtcgtactacgcgtcctggtaccagcagaagccgggacaggccccggtcctggtcattttcggacgctcaagacgcccatcgggcatcccggaccggttcagcggaagctcctcgggaaacaccgcgtcacttatcattaccggcgcacaggctgaggacgaagcggattactactgcaactcccgcgacaatactgccaaccattacgtgttcgggaccggaacgaaactgactgtcctg

SEQ ID NO: 607 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcaactcgtggaatctggtggaggacttgtgcaacctggaagatcgttgagactctcatgtgctgcctccgggttcacctttgacgactacgccatgcactgggtgcgccaggcaccaggaaagggtctggagtgggtttcgggtatctcgtggaactccgggagcactggctacgctgattcggtgaaaggccggtttaccatctcccgagacaatgcgaagaattccctctatctgcagatgaacagcctccgggccgaggatactgccctgtactactgcgccaaggatagctcatcatggtacggaggtggatcggctttcgatatctggggccagggcacgatggtcaccgtgtcctcggggggcggaggctccgggggaggaggtagcggaggaggaggatcgagctcagagttgactcaagaacccgcagtgtccgtggcactgggccaaaccgtcaggatcacttgccagggagacagcctgaggtcgtactacgcgtcctggtaccagcagaagccgggacaggccccggtcctggtcattttcggacgctcaagacgcccatcgggcatcccggaccggttcagcggaagctcctcgggaaacaccgcgtcacttatcattaccggcgcacaggctgaggacgaagcggattactactgcaactcccgcgacaatactgccaaccattacgtgttcgggaccggaacgaaactgactgtcctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 608 - DNA, 738 bp, Artificial Sequence
  Description of Artificial Sequence: Synthetic polynucleotide
gaagttcaattggtggaatctggaggaggacttgtgcaacccggtagatctctgagactgtcctgtgcggcatcgggattcaccttcgacgactacgctatgcactgggtgagacaagcccctggaaaaggactggagtgggtgtcaggcatctcctggaatagcgggtccactggatacgccgattcggtcaagggtcgcttcaccatttcccgggacaatgccaagaactccctgtaccttcaaatgaactccctccgggccgaggataccgccctctactactgcgccaaagacagctcgtcatggtatggcggagggtcggcatttgacatctggggacagggaactatggtgactgtgtcatcaggaggcggcggaagcggcggcggcgggtccggcggaggagggtcgtccagcgaactcacccaagatccagcagtgagcgtcgcgctgggccagaccgtcaggatcacgtgccagggagattcactgcgctcatactacgcgtcctggtaccagcagaagccggggcaggccccggtcctcgtgatctacggaaagaacaaccgcccgtcgggtatcccagaccgcttttcgggtagctccagcggaaatacggctagcctgaccatcactggagcacaggctgaggatgaagcggactactactgcaattcgcggggctcatcggggaaccattacgtgttcggaactggtaccaaggtgactgtcctg

SEQ ID NO: 609 - DNA, 1470 bp, Artificial Sequence
  Description of Artificial Sequence: Synthetic polynucleotide
atggccctccctgtcaccgccctgctgcttccgctggctcttctgctccacgccgctcggcccgaagttcaattggtggaatctggaggaggacttgtgcaacccggtagatctctgagactgtcctgtgcggcatcgggattcaccttcgacgactacgctatgcactgggtgagacaagcccctggaaaaggactggagtgggtgtcaggcatctcctggaatagcgggtccactggatacgccgattcggtcaagggtcgcttcaccatttcccgggacaatgccaagaactccctgtaccttcaaatgaactccctccgggccgaggataccgccctctactactgcgccaaagacagctcgtcatggtatggcggagggtcggcatttgacatctggggacagggaactatggtgactgtgtcatcaggaggcggcggaagcggcggcggcgggtccggcggaggagggtcgtccagcgaactcacccaagatccagcagtgagcgtcgcgctgggccagaccgtcaggatcacgtgccagggagattcactgcgctcatactacgcgtcctggtaccagcagaagccggggcaggccccggtcctcgtgatctacggaaagaacaaccgcccgtcgggtatcccagaccgcttttcgggtagctccagcggaaatacggctagcctgaccatcactggagcacaggctgaggatgaagcggactactactgcaattcgcggggctcatcggggaaccattacgtgttcggaactggtaccaaggtgactgtcctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 610 - DNA, 753 bp, Artificial Sequence
  Description of Artificial Sequence: Synthetic polynucleotide
caagtgcagctcgttcaatcaggcggaggactcgttcaaccaggaggatcattgcgactctcatgtgcggcctctggattcacgtttagctcatattggatgcactgggtgcggcaggcgccggggaaaggtctggtgtgggtcagccgcatcaactcagacggctcctcgacttcgtacgccgactccgtgaagggacgctttaccatttcccgcgacaacgccaagaataccctttaccttcagatgaactccctccgcgctgaggataccgccgtgtactactgcgtgaggactggctgggtcggcagctactactactacatggacgtgtggggcaaaggaactactgtcaccgtgtcaagcggcggtggaggttccggcgggggaggatcgggggggggcggatcgggtggcggaggatcggagatcgtgttgacccagtcgccgggaaccctgtcgctgtcgcctggggagagagcaactctgtcctgccgggcttcccagtcggtgtcgagcaattacctggcatggtaccaacagaagccgggacagccgccacgcctgctgatctatgacgtgtcaactcgggcaactggaatccctgcgcggttcagcggcggagggagcggtaccgatttcaccctgactatttcctccctcgaaccagaagatttcgccgtctactactgccagcagagaagcaactggccgccctggacgttcggacaaggaaccaaggtcgaaatcaag

SEQ ID NO: 611 - DNA, 1485 bp, Artificial Sequence
  Description of Artificial Sequence: Synthetic polynucleotide
atggccctccctgtcaccgccctgctgcttccgctggctcttctgctccacgccgctcggccccaagtgcagctcgttcaatcaggcggaggactcgttcaaccaggaggatcattgcgactctcatgtgcggcctctggattcacgtttagctcatattggatgcactgggtgcggcaggcgccggggaaaggtctggtgtgggtcagccgcatcaactcagacggctcctcgacttcgtacgccgactccgtgaagggacgctttaccatttcccgcgacaacgccaagaataccctttaccttcagatgaactccctccgcgctgaggataccgccgtgtactactgcgtgaggactggctgggtcggcagctactactactacatggacgtgtggggcaaaggaactactgtcaccgtgtcaagcggcggtggaggttccggcgggggaggatcgggggggggcggatcgggtggcggaggatcggagatcgtgttgacccagtcgccgggaaccctgtcgctgtcgcctggggagagagcaactctgtcctgccgggcttcccagtcggtgtcgagcaattacctggcatggtaccaacagaagccgggacagccgccacgcctgctgatctatgacgtgtcaactcgggcaactggaatccctgcgcggttcagcggcggagggagcggtaccgatttcaccctgactatttcctccctcgaaccagaagatttcgccgtctactactgccagcagagaagcaactggccgccctggacgttcggacaaggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 612 - DNA, 750 bp, Artificial Sequence
  Description of Artificial Sequence: Synthetic polynucleotide
caagtgcaattggttcaatcaggaggaggagtcgtgcagcccggaagatcgttgagactgtcatgtgccgcgagcggctttactttctcaagctacggaatgcattgggtgcgacaggctccgggaaaaggactggaatgggtcgcagtgatctcatacgacggctcgaacaagtactacgccgactccgtcaagggtcggttcacgatttcgcgcgataattccaagaacactctgtacctccaaatgaacagcctccgggcagaggacaccgccgtctactactgcgctaagggatactcgcgctactactactatggaatggatgtgtggggccagggaactaccgtgacggtgtcgtccggcggcggtgggtcgggcggaggcggatcaggtggaggtggaagcggaggaggagggagcgaaatcgtcatgactcagtcccctgctaccctttctctgtcgccgggagaaagagccatcctgagctgccgggcctcccagagcgtgtacaccaaatacctgggatggtaccagcagaagccggggcaggcaccaaggctcctgatctacgatgcgtccacccgcgcgactggtatcccagaccgcttttccggctcggggtcagggactgacttcacccttactatcaatcggctcgagcctgaggatttcgccgtgtattactgccagcactacggagggtccccgctgattaccttcggccaaggcaccaaagtggacatcaag

SEQ ID NO: 613 - DNA, 1482 bp, Artificial Sequence
  Description of Artificial Sequence: Synthetic polynucleotide
atggccctccctgtcaccgccctgctgcttccgctggctcttctgctccacgccgctcggccccaagtgcaattggttcaatcaggaggaggagtcgtgcagcccggaagatcgttgagactgtcatgtgccgcgagcggctttactttctcaagctacggaatgcattgggtgcgacaggctccgggaaaaggactggaatgggtcgcagtgatctcatacgacggctcgaacaagtactacgccgactccgtcaagggtcggttcacgatttcgcgcgataattccaagaacactctgtacctccaaatgaacagcctccgggcagaggacaccgccgtctactactgcgctaagggatactcgcgctactactactatggaatggatgtgtggggccagggaactaccgtgacggtgtcgtccggcggcggtgggtcgggcggaggcggatcaggtggaggtggaagcggaggaggagggagcgaaatcgtcatgactcagtcccctgctaccctttctctgtcgccgggagaaagagccatcctgagctgccgggcctcccagagcgtgtacaccaaatacctgggatggtaccagcagaagccggggcaggcaccaaggctcctgatctacgatgcgtccacccgcgcgactggtatcccagaccgcttttccggctcggggtcagggactgacttcacccttactatcaatcggctcgagcctgaggatttcgccgtgtattactgccagcactacggagggtccccgctgattaccttcggccaaggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 614 - DNA, 747 bp, Artificial Sequence
  Description of Artificial Sequence: Synthetic polynucleotide
caagtgcaacttgttcaatcaggaggaggactcgttcaacccggaggatcactgcgactctcatgtgcagcgtcggggttcaccttctccagctacgcaatgtcctgggtgcgccaagcccctggaaaaggcctggagtgggtgtcggccatctctgggagcgggggatcaacttactacgctgactccgtcaagggccgctttaccatctcccgggacaacagcaagaacactctctatctccagatgaactcgctgagagccgaagataccgctgtctactactgcgcgaagagagaagctgccgcagggcacgattggtacttcgacttgtggggcaggggcacccttgtgaccgtgtcctccggtggaggcggatcaggaggtgggggatcgggtggaggaggaagcggaggcggcggttcggacattcgcgtcacccagtcaccgagctccctcagcgcatcggtgggcgaccgggtcactatcacttgccgggcgtcccagtcgatctcatcgtatctgaattggtaccagcagaaaccgggaaaggcgccgaagctgttgatctacgctgccagctccctgcagtcgggtgtgccatcacgcttttccggctcgggatcgggaaccgatttcactctgacgatctctagcctgcagccagaagatttcgccacttactactgccagcagtcctacagcatccctctgactttcggacaagggacgaaagtggagattaag

SEQ ID NO: 615 - DNA, 1479 bp, Artificial Sequence
  Description of Artificial Sequence: Synthetic polynucleotide
atggccctccctgtcaccgccctgctgcttccgctggctcttctgctccacgccgctcggccccaagtgcaacttgttcaatcaggaggaggactcgttcaacccggaggatcactgcgactctcatgtgcagcgtcggggttcaccttctccagctacgcaatgtcctgggtgcgccaagcccctggaaaaggcctggagtgggtgtcggccatctctgggagcgggggatcaacttactacgctgactccgtcaagggccgctttaccatctcccgggacaacagcaagaacactctctatctccagatgaactcgctgagagccgaagataccgctgtctactactgcgcgaagagagaagctgccgcagggcacgattggtacttcgacttgtggggcaggggcacccttgtgaccgtgtcctccggtggaggcggatcaggaggtgggggatcgggtggaggaggaagcggaggcggcggttcggacattcgcgtcacccagtcaccgagctccctcagcgcatcggtgggcgaccgggtcactatcacttgccgggcgtcccagtcgatctcatcgtatctgaattggtaccagcagaaaccgggaaaggcgccgaagctgttgatctacgctgccagctccctgcagtcgggtgtgccatcacgcttttccggctcgggatcgggaaccgatttcactctgacgatctctagcctgcagccagaagatttcgccacttactactgccagcagtcctacagcatccctctgactttcggacaagggacgaaagtggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 616 - DNA, 741 bp, Artificial Sequence
  Description of Artificial Sequence: Synthetic polynucleotide
caagtccaactcgttcagtcatgggcagaagtcaagaaacccggtgcaagcgtcaaagtgtcgtgtaaggcctccggctacactttcacttcctactacatgcactgggtgcgccaagccccgggacagggccttgaatggatgggcatcatcaacccatcaggaggttccacgagctacgcgcagaagttccaggggagagtgacgatgactagagatacctccacgagcaccgtctacatggagctgtcgaatctgcggtcagaggacactgctgtgtattactgcgcgcgctccccgcgggtgaccactggctactttgactactggggacaagggaccctggtgaccgtcagctcgggaggcggaggatcgggaggtggagggtccggtggaggcggctctggaggaggcgggtcggacattcaattgacccagagcccatccaccctctcagcctcggtgggggatagggtgactatcacttgccgggcctcccagtcaatttccagctggctggcttggtaccagcaaaagcctggaaaggcaccgaagctcctgatctacaaggcctcatctctggaatcaggagtgccttcgcgcttcagcggaagcggctcgggaactgagtttaccctgaccatctcgagcctgcagccagatgacttcgcgacctattactgccagcagtactcgtcctacccgttgactttcggaggaggtacccgcctcgaaatcaaa

SEQ ID NO: 617 - DNA, 1473 bp, Artificial Sequence
  Description of Artificial Sequence: Synthetic polynucleotide
atggccctccctgtcaccgccctgctgcttccgctggctcttctgctccacgccgctcggccccaagtccaactcgttcagtcatgggcagaagtcaagaaacccggtgcaagcgtcaaagtgtcgtgtaaggcctccggctacactttcacttcctactacatgcactgggtgcgccaagccccgggacagggccttgaatggatgggcatcatcaacccatcaggaggttccacgagctacgcgcagaagttccaggggagagtgacgatgactagagatacctccacgagcaccgtctacatggagctgtcgaatctgcggtcagaggacactgctgtgtattactgcgcgcgctccccgcgggtgaccactggctactttgactactggggacaagggaccctggtgaccgtcagctcgggaggcggaggatcgggaggtggagggtccggtggaggcggctctggaggaggcgggtcggacattcaattgacccagagcccatccaccctctcagcctcggtgggggatagggtgactatcacttgccgggcctcccagtcaatttccagctggctggcttggtaccagcaaaagcctggaaaggcaccgaagctcctgatctacaaggcctcatctctggaatcaggagtgccttcgcgcttcagcggaagcggctcgggaactgagtttaccctgaccatctcgagcctgcagccagatgacttcgcgacctattactgccagcagtactcgtcctacccgttgactttcggaggaggtacccgcctcgaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 618 - DNA, 759 bp, Artificial Sequence
  Description of Artificial Sequence: Synthetic polynucleotide
caagtccaactcgtccagtccggtgcagaagtcagaaggccaggagcaagcgtgaagatctcgtgtagagcgtcaggagacaccagcactcgccattacatccactggctgcgccaggctccgggccaagggccggagtggatgggtgtgatcaacccgactacgggaccggctaccggaagccctgcgtacgcacagatgctgcagggacgggtgactatgacccgcgatactagcactaggaccgtgtacatggaactccgctcgttgcggttcgaagataccgccgtctactactgcgcccggtccgtggtgggccgaagcgccccttactacttcgattactggggacagggcactctggtgaccgttagctccggtgggggaggctcgggtggaggcggatcgggaggaggaggcagcggtggagggggatcggacattcagatgacccagtcaccctcctccctctcagcctcggtcggggaccgggtgaccattacgtgcagagcctcacaagggatctcggactactccgcctggtaccagcagaaaccgggaaaagcgccaaagctcctgatctacgccgcgagcaccctgcaatcaggagtgccatcgcgcttttctggatcgggctcagggactgacttcacgctgactatctcctaccttcagtccgaggatttcgctacctactactgccaacagtattactcctatcccctgacctttggcggaggcactaaggtggacatcaag

SEQ ID NO: 619 - DNA, 1491 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcagaaggccaggagcaagcgtgaagatctcgtgtagagcgtcaggagacaccagcactcgccattacatccactggctgcgccaggctccgggccaagggccggagtggatgggtgtgatcaacccgactacgggaccggctaccggaagccctgcgtacgcacagatgctgcagggacgggtgactatgacccgcgatactagcactaggaccgtgtacatggaactccgctcgttgcggttcgaagataccgccgtctactactgcgcccggtccgtggtgggccgaagcgccccttactacttcgattactggggacagggcactctggtgaccgttagctccggtgggggaggctcgggtggaggcggatcgggaggaggaggcagcggtggagggggatcggacattcagatgacccagtcaccctcctccctctcagcctcggtcggggaccgggtgaccattacgtgcagagcctcacaagggatctcggactactccgcctggtaccagcagaaaccgggaaaagcgccaaagctcctgatctacgccgcgagcaccctgcaatcaggagtgccatcgcgcttttctggatcgggctcagggactgacttcacgctgactatctcctaccttcagtccgaggatttcgctacctactactgccaacagtattactcctatcccctgacctttggcggaggcactaaggtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 620 - DNA, 747 bp, Artificial Sequence
  Description of Artificial Sequence: Synthetic polynucleotide
caagtccaactccagcaatcgggagcagaagtcaagaaaccaggcgcatcggtgaaagtgtcgtgtaaggcgtcagggtacaccttcaccaactactatatgcactgggtgcgccaggctccaggccaggggttggagtggatggggatcatcaatccgtcaggtggctacaccacttacgctcagaagttccagggacgcctcactatgactcgcgatactagcacctccacggtgtacatggaactgtcatcgctgaggtccgaagataccgccgtctactactgcgcacggatcagatcctgcggaggagattgttactactttgacaactggggacagggcacccttgttactgtgtcatcgggaggagggggaagcggaggaggtggatcaggcggcggtggcagcgggggcggaggatcggacattcagctgactcagtccccctccactttgtcggccagcgtgggagacagagtgaccatcacttgccgggcgtccgagaacgtcaatatctggctggcctggtaccagcaaaagcctggaaaagccccgaagctgctcatctataagtcatccagcctggcgtctggtgtgccgtcgcggttctccggcagcgggagcggagccgagttcactctcaccatttcgagccttcaaccggacgatttcgccacctactactgccagcagtaccaatcctaccctctgacgtttggaggtggaaccaaggtggacatcaag

SEQ ID NO: 621 - DNA, 1479 bp, Artificial Sequence
  Description of Artificial Sequence: Synthetic polynucleotide
atggccctccctgtcaccgccctgctgcttccgctggctcttctgctccacgccgctcggccccaagtccaactccagcaatcgggagcagaagtcaagaaaccaggcgcatcggtgaaagtgtcgtgtaaggcgtcagggtacaccttcaccaactactatatgcactgggtgcgccaggctccaggccaggggttggagtggatggggatcatcaatccgtcaggtggctacaccacttacgctcagaagttccagggacgcctcactatgactcgcgatactagcacctccacggtgtacatggaactgtcatcgctgaggtccgaagataccgccgtctactactgcgcacggatcagatcctgcggaggagattgttactactttgacaactggggacagggcacccttgttactgtgtcatcgggaggagggggaagcggaggaggtggatcaggcggcggtggcagcgggggcggaggatcggacattcagctgactcagtccccctccactttgtcggccagcgtgggagacagagtgaccatcacttgccgggcgtccgagaacgtcaatatctggctggcctggtaccagcaaaagcctggaaaagccccgaagctgctcatctataagtcatccagcctggcgtctggtgtgccgtcgcggttctccggcagcgggagcggagccgagttcactctcaccatttcgagccttcaaccggacgatttcgccacctactactgccagcagtaccaatcctaccctctgacgtttggaggtggaaccaaggtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 622 - DNA, 738 bp, Artificial Sequence
  Description of Artificial Sequence: Synthetic polynucleotide
caaatcactctgaaagaatctggaccggccctggttaagccgactcaaacgctcacccttacttgcaccttcagcggattctcactcagcactgctggtgtgcacgtcggatggattagacagccgcctggaaaggccctggaatggctcgccctcatctcctgggccgatgacaagagatacaggccctcgcttcgatcccggttggacattacccgggtgacctcgaaagatcaggtggtgctctcaatgaccaatatgcagccggaggacaccgctacgtactactgcgcactgcaaggatttgacggctacgaggctaactggggaccaggtactctggtcaccgtgagctccggcgggggaggatcaggcgggggggggtcaggaggcggaggctccggtggaggaggatcggatatcgtcatgacccagtccccaagctcgctgagcgcgtcagcgggcgaccgcgtgactatcacttgccgggccagccgcggcatctcctccgcactggcgtggtaccagcagaagcctggaaaaccgccaaagctcctgatctatgatgcctccagcctggagtcaggtgtccccagccgcttctcgggttcgggctcgggaaccgacttcactttgaccatcgactcgctggaaccggaagatttcgcaacctactactgtcagcagtcctactcgaccccttggacttttggacaagggacgaaggtggacatcaag

SEQ ID NO: 623 - DNA, 1470 bp, Artificial Sequence
  Description of Artificial Sequence: Synthetic polynucleotide
atggccctccctgtcaccgccctgctgcttccgctggctcttctgctccacgccgctcggccccaaatcactctgaaagaatctggaccggccctggttaagccgactcaaacgctcacccttacttgcaccttcagcggattctcactcagcactgctggtgtgcacgtcggatggattagacagccgcctggaaaggccctggaatggctcgccctcatctcctgggccgatgacaagagatacaggccctcgcttcgatcccggttggacattacccgggtgacctcgaaagatcaggtggtgctctcaatgaccaatatgcagccggaggacaccgctacgtactactgcgcactgcaaggatttgacggctacgaggctaactggggaccaggtactctggtcaccgtgagctccggcgggggaggatcaggcgggggggggtcaggaggcggaggctccggtggaggaggatcggatatcgtcatgacccagtccccaagctcgctgagcgcgtcagcgggcgaccgcgtgactatcacttgccgggccagccgcggcatctcctccgcactggcgtggtaccagcagaagcctggaaaaccgccaaagctcctgatctatgatgcctccagcctggagtcaggtgtccccagccgcttctcgggttcgggctcgggaaccgacttcactttgaccatcgactcgctggaaccggaagatttcgcaacctactactgtcagcagtcctactcgaccccttggacttttggacaagggacgaaggtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 624 - DNA, 717 bp, Artificial Sequence
  Description of Artificial Sequence: Synthetic polynucleotide
caagtccagctccagcagtcgggcccagagttggagaagcctggggcgagcgtgaagatctcatgcaaagcctcaggctactcctttactggatacacgatgaattgggtgaaacagtcgcatggaaagtcactggaatggatcggtctgattacgccctacaacggcgcctccagctacaaccagaagttcaggggaaaggcgacccttactgtcgacaagtcgtcaagcaccgcctacatggacctcctgtccctgacctccgaagatagcgcggtctacttttgtgcacgcggaggttacgatggacggggattcgactactggggccagggaaccactgtcaccgtgtcgagcggaggcggagggagcggaggaggaggcagcggaggtggagggtcggatatcgaactcactcagtccccagcaatcatgtccgcttcaccgggagaaaaggtgaccatgacttgctcggcctcctcgtccgtgtcatacatgcactggtaccaacaaaaatcggggacctcccctaagagatggatctacgataccagcaaactggcttcaggcgtgccgggacgcttctcgggttcggggagcggaaattcgtattcgttgaccatttcgtccgtggaagccgaggacgacgcaacttattactgccaacagtggtcaggctacccgctcactttcggagccggcactaagctggagatc

SEQ ID NO: 625 - DNA, 1149 bp, Artificial Sequence
  Description of Artificial Sequence: Synthetic polynucleotide
atggccctccctgtcaccgccctgctgcttccgctggctcttctgctccacgccgctcggccccaagtccagctccagcagtcgggcccagagttggagaagcctggggcgagcgtgaagatctcatgcaaagcctcaggctactcctttactggatacacgatgaattgggtgaaacagtcgcatggaaagtcactggaatggatcggtctgattacgccctacaacggcgcctccagctacaaccagaagttcaggggaaaggcgacccttactgtcgacaagtcgtcaagcaccgcctacatggacctcctgtccctgacctccgaagatagcgcggtctacttttgtgcacgcggaggttacgatggacggggattcgactactggggccagggaaccactgtcaccgtgtcgagcggaggcggagggagcggaggaggaggcagcggaggtggagggtcggatatcgaactcactcagtccccagcaatcatgtccgcttcaccgggagaaaaggtgaccatgacttgctcggcctcctcgtccgtgtcatacatgcactggtaccaacaaaaatcggggacctcccctaagagatggatctacgataccagcaaactggcttcaggcgtgccgggacgcttctcgggttcggggagcggaaattcgtattcgttgaccatttcgtccgtggaagccgaggacgacgcaacttattactgccaacagtggtcaggctacccgctcactttcggagccggcactaagctggagatcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcc

SEQ ID NO: 626 - protein, 249 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSSGGGGSGGGGSGGGGSGGGGSDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKR

SEQ ID NO: 627 - protein, 249 aa, Artificial Sequence
  Description of Artificial Sequence: Synthetic polypeptide
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSS

SEQ ID NO: 628 - protein, 239 aa, Artificial Sequence
  Description of Artificial Sequence: Synthetic polypeptide
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 629 - DNA, 717 bp, Artificial Sequence
  Description of Artificial Sequence: Synthetic polynucleotide
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 630 - protein, 115 aa, Artificial Sequence
  Description of Artificial Sequence: Synthetic polypeptide
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 631 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 632 - protein, 483 aa, Artificial Sequence
  Description of Artificial Sequence: Synthetic polypeptide
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 633 - DNA, 1449 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 634 - protein, 246 aa, Artificial Sequence
  Description of Artificial Sequence: Synthetic polypeptide
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 635 - DNA, 738 bp, Artificial Sequence
  Description of Artificial Sequence: Synthetic polynucleotide
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 636 - protein, 120 aa, Artificial Sequence
  Description of Artificial Sequence: Synthetic polypeptide
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 637 - protein, 109 aa, Artificial Sequence
  Description of Artificial Sequence: Synthetic polypeptide
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 638 - protein, 490 aa, Artificial Sequence
  Description of Artificial Sequence: Synthetic polypeptide
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 639 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 640 - protein, 244 aa, Artificial Sequence
  Description of Artificial Sequence: Synthetic polypeptide
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 641 - DNA, 732 bp, Artificial Sequence
  Description of Artificial Sequence: Synthetic polynucleotide
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 642 - protein, 115 aa, Artificial Sequence
  Description of Artificial Sequence: Synthetic polypeptide
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 643 - protein, 112 aa, Artificial Sequence
  Description of Artificial Sequence: Synthetic polypeptide
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 644 - protein, 488 aa, Artificial Sequence
  Description of Artificial Sequence: Synthetic polypeptide
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 645 - DNA, 1464 bp, Artificial Sequence
  Description of Artificial Sequence: Synthetic polynucleotide
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 646 - protein, 243 aa, Artificial Sequence
  Description of Artificial Sequence: Synthetic polypeptide
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 647 - DNA, 729 bp, Artificial Sequence
  Description of Artificial Sequence: Synthetic polynucleotide
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 648 - protein, 115 aa, Artificial Sequence
  Description of Artificial Sequence: Synthetic polypeptide
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 649 - protein, 111 aa, Artificial Sequence
  Description of Artificial Sequence: Synthetic polypeptide
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 650 - protein, 487 aa, Artificial Sequence
  Description of Artificial Sequence: Synthetic polypeptide
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 651 - DNA, 1461 bp, Artificial Sequence
  Description of Artificial Sequence: Synthetic polynucleotide
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 652 - protein, 249 aa, Artificial Sequence
  Description of Artificial Sequence: Synthetic polypeptide
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 653 - DNA, 747 bp, Artificial Sequence
  Description of Artificial Sequence: Synthetic polynucleotide
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 654 - protein, 120 aa, Artificial Sequence
  Description of Artificial Sequence: Synthetic polypeptide
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 655 - protein, 112 aa, Artificial Sequence
  Description of Artificial Sequence: Synthetic polypeptide
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 656 - protein, 493 aa, Artificial Sequence
  Description of Artificial Sequence: Synthetic polypeptide
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 657 - DNA, 1479 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 658 - protein, 246 aa, Artificial Sequence
  Description of Artificial Sequence: Synthetic polypeptide
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 659 - DNA, 738 bp, Artificial Sequence
  Description of Artificial Sequence: Synthetic polynucleotide
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 660 - protein, 123 aa, Artificial Sequence
  Description of Artificial Sequence: Synthetic polypeptide
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 661 - protein, 106 aa, Artificial Sequence
  Description of Artificial Sequence: Synthetic polypeptide
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 662 - protein, 490 aa, Artificial Sequence
  Description of Artificial Sequence: Synthetic polypeptide
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 663 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 664 - protein, 247 aa, Artificial Sequence
  Description of Artificial Sequence: Synthetic polypeptide
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 665 - DNA, 741 bp, Artificial Sequence
  Description of Artificial Sequence: Synthetic polynucleotide
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 666 - protein, 118 aa, Artificial Sequence
  Description of Artificial Sequence: Synthetic polypeptide
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 667 - protein, 112 aa, Artificial Sequence
  Description of Artificial Sequence: Synthetic polypeptide
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 668 - protein, 491 aa, Artificial Sequence
  Description of Artificial Sequence: Synthetic polypeptide
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 669 - DNA, 1473 bp, Artificial Sequence
  Description of Artificial Sequence: Synthetic polynucleotide
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 670 - protein, 238 aa, Artificial Sequence
  Description of Artificial Sequence: Synthetic polypeptide
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 671 - DNA, 714 bp, Artificial Sequence
  Description of Artificial Sequence: Synthetic polynucleotide
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 672 - protein, 115 aa, Artificial Sequence
  Description of Artificial Sequence: Synthetic polypeptide
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 673 - protein, 106 aa, Artificial Sequence
  Description of Artificial Sequence: Synthetic polypeptide
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 674 - protein, 482 aa, Artificial Sequence
  Description of Artificial Sequence: Synthetic polypeptide
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 675 - DNA, 1446 bp, Artificial Sequence
  Description of Artificial Sequence: Synthetic polynucleotide
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 676 - protein, 239 aa, Artificial Sequence
  Description of Artificial Sequence: Synthetic polypeptide
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 677 - DNA, 717 bp, Artificial Sequence
  Description of Artificial Sequence: Synthetic polynucleotide
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 678 - protein, 115 aa, Artificial Sequence
  Description of Artificial Sequence: Synthetic polypeptide
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 679 - protein, 107 aa, Artificial Sequence
  Description of Artificial Sequence: Synthetic polypeptide
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 680 - protein, 483 aa, Artificial Sequence
  Description of Artificial Sequence: Synthetic polypeptide
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 681 - DNA, 1449 bp, Artificial Sequence
  Description of Artificial Sequence: Synthetic polynucleotide
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 682 - protein, 241 aa, Artificial Sequence
  Description of Artificial Sequence: Synthetic polypeptide
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 683 - DNA, 723 bp, Artificial Sequence
  Description of Artificial Sequence: Synthetic polynucleotide
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 684 - protein, 115 aa, Artificial Sequence
  Description of Artificial Sequence: Synthetic polypeptide
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 685 - protein, 109 aa, Artificial Sequence
  Description of Artificial Sequence: Synthetic polypeptide
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 686 - protein, 485 aa, Artificial Sequence
  Description of Artificial Sequence: Synthetic polypeptide
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 687 - DNA, 1455 bp, Artificial Sequence
  Description of Artificial Sequence: Synthetic polynucleotide
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 688 - protein, 239 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 689 - DNA, 717 bp, Artificial Sequence
  Description of Artificial Sequence: Synthetic polynucleotide
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 690 - protein, 117 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 691 - protein, 105 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 692 - protein, 483 aa, Artificial Sequence
  Description of Artificial Sequence: Synthetic polypeptide
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 693 - DNA, 1449 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 694 - protein, 246 aa, Artificial Sequence
  Description of Artificial Sequence: Synthetic polypeptide
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 695 - DNA, 738 bp, Artificial Sequence
  Description of Artificial Sequence: Synthetic polynucleotide
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 696 - protein, 117 aa, Artificial Sequence
  Description of Artificial Sequence: Synthetic polypeptide
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 697 - protein, 112 aa, Artificial Sequence
  Description of Artificial Sequence: Synthetic polypeptide
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 698 - protein, 490 aa, Artificial Sequence
  Description of Artificial Sequence: Synthetic polypeptide
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 699 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 700 - protein, 239 aa, Artificial Sequence
  Description of Artificial Sequence: Synthetic polypeptide
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 701 - DNA, 717 bp, Artificial Sequence
  Description of Artificial Sequence: Synthetic polynucleotide
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 702 - protein, 115 aa, Artificial Sequence
  Description of Artificial Sequence: Synthetic polypeptide
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 703 - protein, 107 aa, Artificial Sequence
  Description of Artificial Sequence: Synthetic polypeptide
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 704 - protein, 483 aa, Artificial Sequence
  Description of Artificial Sequence: Synthetic polypeptide
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 705 - DNA, 1449 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 706 - protein, 240 aa, Artificial Sequence
  Description of Artificial Sequence: Synthetic polypeptide
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 707 - DNA, 720 bp, Artificial Sequence
  Description of Artificial Sequence: Synthetic polynucleotide
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 708 - protein, 115 aa, Artificial Sequence; identical to SEQ ID NO: 678
  Description of Artificial Sequence: Synthetic polypeptide

SEQ ID NO: 709 - protein, 108 aa, Artificial Sequence
  Description of Artificial Sequence: Synthetic polypeptide
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 710 - protein, 484 aa, Artificial Sequence
  Description of Artificial Sequence: Synthetic polypeptide
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 711 - DNA, 1452 bp, Artificial Sequence
  Description of Artificial Sequence: Synthetic polynucleotide
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 712 - protein, 241 aa, Artificial Sequence
  Description of Artificial Sequence: Synthetic polypeptide
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 713 - DNA, 723 bp, Artificial Sequence
  Description of Artificial Sequence: Synthetic polynucleotide
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 714 - protein, 115 aa, Artificial Sequence; identical to SEQ ID NO: 630
  Description of Artificial Sequence: Synthetic polypeptide

SEQ ID NO: 715 - protein, 109 aa, Artificial Sequence
  Description of Artificial Sequence: Synthetic polypeptide
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 716 - protein, 485 aa, Artificial Sequence
  Description of Artificial Sequence: Synthetic polypeptide
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 717 - DNA, 1455 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 718 - protein, 243 aa, Artificial Sequence
  Description of Artificial Sequence: Synthetic polypeptide
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 719 - DNA, 729 bp, Artificial Sequence
  Description of Artificial Sequence: Synthetic polynucleotide
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 720 - protein, 121 aa, Artificial Sequence
  Description of Artificial Sequence: Synthetic polypeptide
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 721 - protein, 107 aa, Artificial Sequence
  Description of Artificial Sequence: Synthetic polypeptide
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 722 - protein, 487 aa, Artificial Sequence
  Description of Artificial Sequence: Synthetic polypeptide
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 723 - DNA, 1461 bp, Artificial Sequence
  Description of Artificial Sequence: Synthetic polynucleotide
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 724 - protein, 244 aa, Artificial Sequence
  Description of Artificial Sequence: Synthetic polypeptide
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 725 - DNA, 735 bp, Artificial Sequence
  Description of Artificial Sequence: Synthetic polynucleotide
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 726 - protein, 123 aa, Artificial Sequence
  Description of Artificial Sequence: Synthetic polypeptide
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 727 - protein, 107 aa, Artificial Sequence
  Description of Artificial Sequence: Synthetic polypeptide
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 728 - protein, 489 aa, Artificial Sequence
  Description of Artificial Sequence: Synthetic polypeptide
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 729 - DNA, 1467 bp, Artificial Sequence
  Description of Artificial Sequence: Synthetic polynucleotide
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 730 - protein, 246 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 731 - DNA, 738 bp, Artificial Sequence
  Description of Artificial Sequence: Synthetic polynucleotide
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 732 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 733 - protein, 112 aa, Artificial Sequence
  Description of Artificial Sequence: Synthetic polypeptide
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 734 - protein, 490 aa, Artificial Sequence
  Description of Artificial Sequence: Synthetic polypeptide
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 735 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 736 - protein, 240 aa, Artificial Sequence
  Description of Artificial Sequence: Synthetic polypeptide
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 737 - DNA, 720 bp, Artificial Sequence
  Description of Artificial Sequence: Synthetic polynucleotide
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 738 - protein, 117 aa, Artificial Sequence
  Description of Artificial Sequence: Synthetic polypeptide
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 739 - protein, 108 aa, Artificial Sequence
  Description of Artificial Sequence: Synthetic polypeptide
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 740 - protein, 484 aa, Artificial Sequence
  Description of Artificial Sequence: Synthetic polypeptide
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 741 - DNA, 1452 bp, Artificial Sequence
  Description of Artificial Sequence: Synthetic polynucleotide
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 742 - protein, 241 aa, Artificial Sequence
  Description of Artificial Sequence: Synthetic polypeptide
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 743 - DNA, 723 bp, Artificial Sequence
  Description of Artificial Sequence: Synthetic polynucleotide
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 744 - protein, 120 aa, Artificial Sequence
  Description of Artificial Sequence: Synthetic polypeptide
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 745 - protein, 106 aa, Artificial Sequence
  Description of Artificial Sequence: Synthetic polypeptide
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 746 - protein, 485 aa, Artificial Sequence
  Description of Artificial Sequence: Synthetic polypeptide
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 747 - DNA, 1455 bp, Artificial Sequence
  Description of Artificial Sequence: Synthetic polynucleotide
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 748 - protein, 245 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 749 - DNA, 735 bp, Artificial Sequence
  Description of Artificial Sequence: Synthetic polynucleotide
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 750 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 751 - protein, 107 aa, Artificial Sequence
  Description of Artificial Sequence: Synthetic polypeptide
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 752 - protein, 489 aa, Artificial Sequence
  Description of Artificial Sequence: Synthetic polypeptide
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 753 - DNA, 1467 bp, Artificial Sequence
  Description of Artificial Sequence: Synthetic polynucleotide
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 754 - protein, 253 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 755 - DNA, 759 bp, Artificial Sequence
  Description of Artificial Sequence: Synthetic polynucleotide
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 756 - protein, 129 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 757 - protein, 109 aa, Artificial Sequence
  Description of Artificial Sequence: Synthetic polypeptide
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 758 - protein, 497 aa, Artificial Sequence
  Description of Artificial Sequence: Synthetic polypeptide
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 759 - DNA, 1491 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 760 - protein, 248 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 761 - DNA, 744 bp, Artificial Sequence
  Description of Artificial Sequence: Synthetic polynucleotide
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 762 - protein, 125 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 763 - protein, 108 aa, Artificial Sequence
  Description of Artificial Sequence: Synthetic polypeptide
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 764 - protein, 492 aa, Artificial Sequence
  Description of Artificial Sequence: Synthetic polypeptide
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 765 - DNA, 1476 bp, Artificial Sequence
  Description of Artificial Sequence: Synthetic polynucleotide
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 766 - protein, 246 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 767 - DNA, 738 bp, Artificial Sequence
  Description of Artificial Sequence: Synthetic polynucleotide
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 768 - protein, 118 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 769 - protein, 113 aa, Artificial Sequence
  Description of Artificial Sequence: Synthetic polypeptide
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 770 - protein, 490 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 771 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 772 - protein, 241 aa, Artificial Sequence
  Description of Artificial Sequence: Synthetic polypeptide
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 773 - DNA, 723 bp, Artificial Sequence
  Description of Artificial Sequence: Synthetic polynucleotide
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 774 - protein, 118 aa, Artificial Sequence
  Description of Artificial Sequence: Synthetic polypeptide
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 775 - protein, 108 aa, Artificial Sequence
  Description of Artificial Sequence: Synthetic polypeptide
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 776 - protein, 485 aa, Artificial Sequence
  Description of Artificial Sequence: Synthetic polypeptide
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 777 - DNA, 1455 bp, Artificial Sequence
  Description of Artificial Sequence: Synthetic polynucleotide
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 778 - protein, 248 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 779 - DNA, 744 bp, Artificial Sequence
  Description of Artificial Sequence: Synthetic polynucleotide
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 780 - protein, 124 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 781 - protein, 109 aa, Artificial Sequence
  Description of Artificial Sequence: Synthetic polypeptide
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 782 - protein, 492 aa, Artificial Sequence
  Description of Artificial Sequence: Synthetic polypeptide
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 783 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 784 - protein, 248 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 785 - DNA, 744 bp, Artificial Sequence
  Description of Artificial Sequence: Synthetic polynucleotide
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 786 - protein, 124 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 787 - protein, 109 aa, Artificial Sequence
  Description of Artificial Sequence: Synthetic polypeptide
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 788 - protein, 492 aa, Artificial Sequence
  Description of Artificial Sequence: Synthetic polypeptide
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 789 - DNA, 1476 bp, Artificial Sequence
  Description of Artificial Sequence: Synthetic polynucleotide
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 790 - protein, 239 aa, Artificial Sequence
  Description of Artificial Sequence: Synthetic polypeptide
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 791 - DNA, 717 bp, Artificial Sequence
  Description of Artificial Sequence: Synthetic polynucleotide
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 792 - protein, 117 aa, Artificial Sequence
  Description of Artificial Sequence: Synthetic polypeptide
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 793 - protein, 107 aa, Artificial Sequence
  Description of Artificial Sequence: Synthetic polypeptide
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 794 - protein, 483 aa, Artificial Sequence
  Description of Artificial Sequence: Synthetic polypeptide
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 795 - DNA, 1449 bp, Artificial Sequence
  Description of Artificial Sequence: Synthetic polynucleotide
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 796 - protein, 246 aa, Artificial Sequence
  Description of Artificial Sequence: Synthetic polypeptide
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 797 - DNA, 738 bp, Artificial Sequence
  Description of Artificial Sequence: Synthetic polynucleotide
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 798 - protein, 122 aa, Artificial Sequence
  Description of Artificial Sequence: Synthetic polypeptide
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 799 - protein, 109 aa, Artificial Sequence
  Description of Artificial Sequence: Synthetic polypeptide
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 800 - protein, 490 aa, Artificial Sequence
  Description of Artificial Sequence: Synthetic polypeptide
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 801 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 802 - protein, 241 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 803 - DNA, 723 bp, Artificial Sequence
  Description of Artificial Sequence: Synthetic polynucleotide
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 804 - protein, 117 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 805 - protein, 109 aa, Artificial Sequence
  Description of Artificial Sequence: Synthetic polypeptide
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 806 - protein, 485 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 807 - DNA, 1455 bp, Artificial Sequence
  Description of Artificial Sequence: Synthetic polynucleotide
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 808 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 809 - DNA, 726 bp, Artificial Sequence
  Description of Artificial Sequence: Synthetic polynucleotide
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 810 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 811 - protein, 109 aa, Artificial Sequence
  Description of Artificial Sequence: Synthetic polypeptide
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 812 - protein, 486 aa, Artificial Sequence
  Description of Artificial Sequence: Synthetic polypeptide
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 813 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 814 - protein, 248 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 815 - DNA, 744 bp, Artificial Sequence
  Description of Artificial Sequence: Synthetic polynucleotide
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 816 - protein, 124 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 817 - protein, 109 aa, Artificial Sequence
  Description of Artificial Sequence: Synthetic polypeptide
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 818 - protein, 492 aa, Artificial Sequence
  Description of Artificial Sequence: Synthetic polypeptide
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 819 - DNA, 1476 bp, Artificial Sequence
  Description of Artificial Sequence: Synthetic polynucleotide
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 820 - protein, 244 aa, Artificial Sequence
  Description of Artificial Sequence: Synthetic polypeptide
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 821 - DNA, 732 bp, Artificial Sequence
  Description of Artificial Sequence: Synthetic polynucleotide
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 822 - protein, 120 aa, Artificial Sequence
  Description of Artificial Sequence: Synthetic polypeptide
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 823 - protein, 109 aa, Artificial Sequence
  Description of Artificial Sequence: Synthetic polypeptide
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 824 - protein, 488 aa, Artificial Sequence
  Description of Artificial Sequence: Synthetic polypeptide
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 825 - DNA, 1464 bp, Artificial Sequence
  Description of Artificial Sequence: Synthetic polynucleotide
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 826 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 827 - DNA, 733 bp, Artificial Sequence
  Description of Artificial Sequence: Synthetic polynucleotide
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 828 - protein, 117 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 829 - protein, 112 aa, Artificial Sequence
  Description of Artificial Sequence: Synthetic polypeptide
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 830 - protein, 488 aa, Artificial Sequence
  Description of Artificial Sequence: Synthetic polypeptide
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 831 - DNA, 1464 bp, Artificial Sequence
  Description of Artificial Sequence: Synthetic polynucleotide
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 832 - protein, 251 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 833 - DNA, 753 bp, Artificial Sequence
  Description of Artificial Sequence: Synthetic polynucleotide
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 834 - protein, 126 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 835 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 836 - protein, 495 aa, Artificial Sequence
  Description of Artificial Sequence: Synthetic polypeptide
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 837 - DNA, 1485 bp, Artificial Sequence
  Description of Artificial Sequence: Synthetic polynucleotide
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 838 - protein, 246 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 839 - DNA, 739 bp, Artificial Sequence
  Description of Artificial Sequence: Synthetic polynucleotide
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 840 - protein, 122 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 841 - protein, 109 aa, Artificial Sequence
  Description of Artificial Sequence: Synthetic polypeptide
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 842 - protein, 490 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 843 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 844 - protein, 122 aa, Artificial Sequence
  Description of Artificial Sequence: Synthetic polypeptide
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 845 - protein, 107 aa, Artificial Sequence
  Description of Artificial Sequence: Synthetic polypeptide
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 846 - protein, 244 aa, Artificial Sequence
  Description of Artificial Sequence: Synthetic polypeptide
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 847 - protein, 467 aa, Artificial Sequence
  Description of Artificial Sequence: Synthetic polypeptide
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 848 - protein, 117 aa, Artificial Sequence
  Description of Artificial Sequence: Synthetic polypeptide
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 849 - protein, 111 aa, Artificial Sequence
  Description of Artificial Sequence: Synthetic polypeptide
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 850 - protein, 249 aa, Artificial Sequence
  Description of Artificial Sequence: Synthetic polypeptide
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 851 - protein, 472 aa, Artificial Sequence
  Description of Artificial Sequence: Synthetic polypeptide
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 852 - protein, 117 aa, Artificial Sequence
  Description of Artificial Sequence: Synthetic polypeptide
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 853 - protein, 111 aa, Artificial Sequence
  Description of Artificial Sequence: Synthetic polypeptide
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 854 - protein, 243 aa, Artificial Sequence
  Description of Artificial Sequence: Synthetic polypeptide
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 855 - protein, 466 aa, Artificial Sequence
  Description of Artificial Sequence: Synthetic polypeptide
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 856 - protein, 117 aa, Artificial Sequence
  Description of Artificial Sequence: Synthetic polypeptide
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 857 - protein, 111 aa, Artificial Sequence; identical to SEQ ID NO: 853
  Description of Artificial Sequence: Synthetic polypeptide

SEQ ID NO: 858 - protein, 243 aa, Artificial Sequence
  Description of Artificial Sequence: Synthetic polypeptide
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 859 - protein, 466 aa, Artificial Sequence
  Description of Artificial Sequence: Synthetic polypeptide
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 860 - protein, 246 aa, Artificial Sequence
  Description of Artificial Sequence: Synthetic polypeptide
QVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSSGGGGSGGGGSGGGGSGGGGSDIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIK

SEQ ID NO: 861 - DNA, 738 bp, Artificial Sequence
  Description of Artificial Sequence: Synthetic polynucleotide
caagtgcaactcgtccagtccggtgcagaagtcaaggaacccggagcctccgtgaaagtgtcctgcaaagctcctgccaacactttctcggaccacgtgatgcactgggtgcgccaggcgccgggccagcgcttcgaatggatgggatacattcatgccgccaatggcggtacccactactcccaaaagttccaggatagagtcaccatcacccgggacaccagcgccaacaccgtgtatatggatctgtccagcctgaggtccgaggataccgccgtgtactactgcgcccggggcggatacaactcagacgcgttcgacatttggggacagggtactatggtcaccgtgtcatccgggggcggtggcagcgggggcggaggctctggcggaggcggatcagggggaggagggtccgacatcgtgatgacccagtccccgtcatcggtgtccgcgtccgtgggagacagagtgaccatcacgtgtcgcgccagccaggacatctcctcgtggttggcatggtaccagcagaagcctggaaaggccccgaagctgctcatctacgccgcctcctcccttcaatcgggagtgccctcgcggttcaacggaagcggaagcgggacagattttaccctgactattagctcgctgcagcccgaggacttcgctacttactactgccaacagagctactccaccccactgactttcggcgggggtaccaaggtcgagatcaag

SEQ ID NO: 862 - protein, 119 aa, Artificial Sequence
  Description of Artificial Sequence: Synthetic polypeptide
QVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSS

SEQ ID NO: 863 - protein, 107 aa, Artificial Sequence
  Description of Artificial Sequence: Synthetic polypeptide
DIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIK

SEQ ID NO: 864 - protein, 490 aa, Artificial Sequence
  Description of Artificial Sequence: Synthetic polypeptide
MALPVTALLLPLALLLHAARPQVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSSGGGGSGGGGSGGGGSGGGGSDIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 865 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaaggaacccggagcctccgtgaaagtgtcctgcaaagctcctgccaacactttctcggaccacgtgatgcactgggtgcgccaggcgccgggccagcgcttcgaatggatgggatacattcatgccgccaatggcggtacccactactcccaaaagttccaggatagagtcaccatcacccgggacaccagcgccaacaccgtgtatatggatctgtccagcctgaggtccgaggataccgccgtgtactactgcgcccggggcggatacaactcagacgcgttcgacatttggggacagggtactatggtcaccgtgtcatccgggggcggtggcagcgggggcggaggctctggcggaggcggatcagggggaggagggtccgacatcgtgatgacccagtccccgtcatcggtgtccgcgtccgtgggagacagagtgaccatcacgtgtcgcgccagccaggacatctcctcgtggttggcatggtaccagcagaagcctggaaaggccccgaagctgctcatctacgccgcctcctcccttcaatcgggagtgccctcgcggttcaacggaagcggaagcgggacagattttaccctgactattagctcgctgcagcccgaggacttcgctacttactactgccaacagagctactccaccccactgactttcggcgggggtaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 866 - protein, 249 aa, Artificial Sequence
  Description of Artificial Sequence: Synthetic polypeptide
QVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSSGGGGSGGGDSGGGGSDIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIK

SEQ ID NO: 867 - DNA, 747 bp, Artificial Sequence
  Description of Artificial Sequence: Synthetic polynucleotide
caagtgcaacttcaagaatcaggcgcaggacttctcaagccatccgaaacactctccctcacttgcgcggtgtacgggggaagcttctcgggatactactggtcctggattaggcagcctcccggcaaaggcctggaatgggtcggggagatcaaccactccggttcaaccaactacaacccgtcgctgaagtcccgcgtgaccatttccgtggacacctctaagaatcagttcagcctgaagctctcgtccgtgaccgcggcggacaccgccgtctactactgcgctcggggatcaggactggtggtgtacgccatccgcgtgggctcgggctggttcgattactggggccagggaaccctggtcactgtgtcgtccggcggaggaggttcggggggcggagacagcggtggagggggtagcgacatccagatgacccagtccccgtcctcgctgtccgcctccgtgggagatagagtgaccatcacctgtcgggcatcccagagcatttccagctacctgaactggtatcagcagaagcccggaaaggcccctaagctgttgatgtacgccgccagcagcttgcagtcgggcgtgccgagccggttttccggttccggctccgggactgacttcaccctgactatctcatccctgcaacccgaggacttcgccacttattactgccagcagtcctactcaacccctccctggacgttcggacagggcaccaaggtcgatatcaag

SEQ ID NO: 868 - protein, 126 aa, Artificial Sequence
  Description of Artificial Sequence: Synthetic polypeptide
QVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSS

SEQ ID NO: 869 - protein, 108 aa, Artificial Sequence
  Description of Artificial Sequence: Synthetic polypeptide
DIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIK

SEQ ID NO: 870 - protein, 493 aa, Artificial Sequence
  Description of Artificial Sequence: Synthetic polypeptide
MALPVTALLLPLALLLHAARPQVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSSGGGGSGGGDSGGGGSDIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 871 - DNA, 1479 bp, Artificial Sequence
  Description of Artificial Sequence: Synthetic polynucleotide
atggccctccctgtcaccgccctgctgcttccgctggctcttctgctccacgccgctcggccccaagtgcaacttcaagaatcaggcgcaggacttctcaagccatccgaaacactctccctcacttgcgcggtgtacgggggaagcttctcgggatactactggtcctggattaggcagcctcccggcaaaggcctggaatgggtcggggagatcaaccactccggttcaaccaactacaacccgtcgctgaagtcccgcgtgaccatttccgtggacacctctaagaatcagttcagcctgaagctctcgtccgtgaccgcggcggacaccgccgtctactactgcgctcggggatcaggactggtggtgtacgccatccgcgtgggctcgggctggttcgattactggggccagggaaccctggtcactgtgtcgtccggcggaggaggttcggggggcggagacagcggtggagggggtagcgacatccagatgacccagtccccgtcctcgctgtccgcctccgtgggagatagagtgaccatcacctgtcgggcatcccagagcatttccagctacctgaactggtatcagcagaagcccggaaaggcccctaagctgttgatgtacgccgccagcagcttgcagtcgggcgtgccgagccggttttccggttccggctccgggactgacttcaccctgactatctcatccctgcaacccgaggacttcgccacttattactgccagcagtcctactcaacccctccctggacgttcggacagggcaccaaggtcgatatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 872 - protein, 248 aa, Artificial Sequence
  Description of Artificial Sequence: Synthetic polypeptide
QVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSSGGGGSGGGGSGGGGSGGGGSDIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIK

SEQ ID NO: 873 - DNA, 744 bp, Artificial Sequence
  Description of Artificial Sequence: Synthetic polynucleotide
caagtgcaacttgttcaatccggtggaggtcttgtgcagcccggaggatcactcagactgtcgtgcgccgcctctgggttcactttctcctcatactcgatgaactgggtgcgccaggcgccgggaaagggcctggaatgggtgtcatacatctcctcctcatcctccaccatctactacgccgattccgtgaagggccgcttcactatttcccgggacaacgcgaaaaactcgctctatctgcaaatgaactccctgcgcgccgaggacaccgccgtgtactactgcgcccgggacctgagcgtgcgggctattgatgcgttcgacatctggggacagggcaccatggtcacagtgtccagcggaggcggcggcagcggtggaggaggatcagggggaggaggttcggggggcggtggctccgatatcgtgctgacccagagcccgtcgagcctctccgcctccgtcggcgacagagtgaccatcacgtgtcaggcatcccaggacattagcaactacctgaattggtaccagcagaagcctggaaaggcacccaagttgctgatctacgacgcctccaacctggaaaccggagtgccatccaggttctcgggcagcggctcgggaaccgacttcacttttactatctcctccctgcaacccgaggatttcgcgacctactactgccagcaggcctacagcacccctttcaccttcgggccgggaactaaggtcgaaatcaag

SEQ ID NO: 874 - protein, 121 aa, Artificial Sequence
  Description of Artificial Sequence: Synthetic polypeptide
QVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSS

SEQ ID NO: 875 - protein, 107 aa, Artificial Sequence
  Description of Artificial Sequence: Synthetic polypeptide
DIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIK

SEQ ID NO: 876 - protein, 492 aa, Artificial Sequence
  Description of Artificial Sequence: Synthetic polypeptide
MALPVTALLLPLALLLHAARPQVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSSGGGGSGGGGSGGGGSGGGGSDIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 877 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcaacttgttcaatccggtggaggtcttgtgcagcccggaggatcactcagactgtcgtgcgccgcctctgggttcactttctcctcatactcgatgaactgggtgcgccaggcgccgggaaagggcctggaatgggtgtcatacatctcctcctcatcctccaccatctactacgccgattccgtgaagggccgcttcactatttcccgggacaacgcgaaaaactcgctctatctgcaaatgaactccctgcgcgccgaggacaccgccgtgtactactgcgcccgggacctgagcgtgcgggctattgatgcgttcgacatctggggacagggcaccatggtcacagtgtccagcggaggcggcggcagcggtggaggaggatcagggggaggaggttcggggggcggtggctccgatatcgtgctgacccagagcccgtcgagcctctccgcctccgtcggcgacagagtgaccatcacgtgtcaggcatcccaggacattagcaactacctgaattggtaccagcagaagcctggaaaggcacccaagttgctgatctacgacgcctccaacctggaaaccggagtgccatccaggttctcgggcagcggctcgggaaccgacttcacttttactatctcctccctgcaacccgaggatttcgcgacctactactgccagcaggcctacagcacccctttcaccttcgggccgggaactaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 878 - protein, 246 aa, Artificial Sequence
  Description of Artificial Sequence: Synthetic polypeptide
EVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSSGGGGSGGGGSGGGGSGGGGSEIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIK

SEQ ID NO: 879 - DNA, 738 bp, Artificial Sequence
  Description of Artificial Sequence: Synthetic polynucleotide
gaagtgcaattggtgcaatcaggaggaggagtggtcagatctggaagaagcctgagactgtcatgcgcggcttcgggctttaccttcaactcctacggcctccactgggtgcgccaggcccccggaaaaggcctcgaatgggtcgcactgattgagtacgacgggtccaacaagtactacggagatagcgtgaagggccgcttcaccatctcacgggacaagtccaagtccaccctgtatctgcaaatggacaacctgagggccgaggatactgccgtgtactactgcgcccgcgaaggaaacgaagatctggccttcgatatttggggccagggtactcttgtgaccgtgtcgagcggaggcggaggctccggtggaggaggatcggggggtggtggttccggcggcggggggagcgaaatcgtgctgacccagtcgccttcctccctctccgcttccgtgggggaccgggtcactattacgtgtcaggcgtcccaattcatcaagaagaatctgaactggtaccagcacaagccgggaaaggcccccaaactgctcatctacgacgccagctcgctgcagactggcgtgccttcccggttttccgggaaccggtcgggaaccaccttctcattcaccatcagcagcctccagccggaggacgtggcgacctactactgccagcagcatgacaaccttccactgactttcggcgggggcaccaaggtcgagattaag

SEQ ID NO: 880 - protein, 119 aa, Artificial Sequence
  Description of Artificial Sequence: Synthetic polypeptide
EVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSS

SEQ ID NO: 881 - protein, 107 aa, Artificial Sequence
  Description of Artificial Sequence: Synthetic polypeptide
EIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIK

SEQ ID NO: 882 - protein, 490 aa, Artificial Sequence
  Description of Artificial Sequence: Synthetic polypeptide
MALPVTALLLPLALLLHAARPEVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSSGGGGSGGGGSGGGGSGGGGSEIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 883 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcaattggtgcaatcaggaggaggagtggtcagatctggaagaagcctgagactgtcatgcgcggcttcgggctttaccttcaactcctacggcctccactgggtgcgccaggcccccggaaaaggcctcgaatgggtcgcactgattgagtacgacgggtccaacaagtactacggagatagcgtgaagggccgcttcaccatctcacgggacaagtccaagtccaccctgtatctgcaaatggacaacctgagggccgaggatactgccgtgtactactgcgcccgcgaaggaaacgaagatctggccttcgatatttggggccagggtactcttgtgaccgtgtcgagcggaggcggaggctccggtggaggaggatcggggggtggtggttccggcggcggggggagcgaaatcgtgctgacccagtcgccttcctccctctccgcttccgtgggggaccgggtcactattacgtgtcaggcgtcccaattcatcaagaagaatctgaactggtaccagcacaagccgggaaaggcccccaaactgctcatctacgacgccagctcgctgcagactggcgtgccttcccggttttccgggaaccggtcgggaaccaccttctcattcaccatcagcagcctccagccggaggacgtggcgacctactactgccagcagcatgacaaccttccactgactttcggcgggggcaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 884 - protein, 255 aa, Artificial Sequence
  Description of Artificial Sequence: Synthetic polypeptide
QVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSSGGGGSGGGGSGGGGSGGGGSDIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIK

SEQ ID NO: 885 - DNA, 765 bp, Artificial Sequence
  Description of Artificial Sequence: Synthetic polynucleotide
caagtgcaactcgtggaatcaggcggaggactcgtgcaacccggaggttcccttagactgtcatgtgccgcttccgggttcaatgtgtccagcaactacatgacctgggtcagacaggcgccgggaaagggacttgaatgggtgtccgtgatctactccggtggagcaacatactacggagactccgtgaaaggccgctttaccgtgtcccgcgataactcgaagaacaccgtgtacttgcagatgaacaggctgactgccgaggacaccgccgtgtattattgcgcccgggacaggctgtactgtggaaacaactgctacctgtactactactacgggatggacgtgtggggacagggcactctcgtcactgtgtcatccggggggggcggtagcggtggcggagggtccggcggaggaggctcagggggaggcggaagcgatatccaggtcacccagtctccctcctcgctgtccgcctccgtgggcgaccgcgtcaccattacttgccgggcgtcgcagtcgatcagctcctacctgaactggtaccagcagaagcctggaaaggccccgaagctgctgatctacgcggcctcgtccctgcaaagcggcgtcccgtcgcggttcagcggttccggttcgggaaccgacttcaccctgactatttcctccctgcaacccgaggatttcgccacttactactgccagcagtcctactccaccccacctctgaccttcggccaaggaaccaaggtcgaaatcaag

SEQ ID NO: 886 - protein, 127 aa, Artificial Sequence
  Description of Artificial Sequence: Synthetic polypeptide
QVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSS

SEQ ID NO: 887 - protein, 108 aa, Artificial Sequence
  Description of Artificial Sequence: Synthetic polypeptide
DIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIK

SEQ ID NO: 888 - protein, 499 aa, Artificial Sequence
  Description of Artificial Sequence: Synthetic polypeptide
MALPVTALLLPLALLLHAARPQVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSSGGGGSGGGGSGGGGSGGGGSDIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 889 - DNA, 1497 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatcaggcggaggactcgtgcaacccggaggttcccttagactgtcatgtgccgcttccgggttcaatgtgtccagcaactacatgacctgggtcagacaggcgccgggaaagggacttgaatgggtgtccgtgatctactccggtggagcaacatactacggagactccgtgaaaggccgctttaccgtgtcccgcgataactcgaagaacaccgtgtacttgcagatgaacaggctgactgccgaggacaccgccgtgtattattgcgcccgggacaggctgtactgtggaaacaactgctacctgtactactactacgggatggacgtgtggggacagggcactctcgtcactgtgtcatccggggggggcggtagcggtggcggagggtccggcggaggaggctcagggggaggcggaagcgatatccaggtcacccagtctccctcctcgctgtccgcctccgtgggcgaccgcgtcaccattacttgccgggcgtcgcagtcgatcagctcctacctgaactggtaccagcagaagcctggaaaggccccgaagctgctgatctacgcggcctcgtccctgcaaagcggcgtcccgtcgcggttcagcggttccggttcgggaaccgacttcaccctgactatttcctccctgcaacccgaggatttcgccacttactactgccagcagtcctactccaccccacctctgaccttcggccaaggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 890 - protein, 247 aa, Artificial Sequence
  Description of Artificial Sequence: Synthetic polypeptide
EVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVL

SEQ ID NO: 891 - DNA, 741 bp, Artificial Sequence
  Description of Artificial Sequence: Synthetic polynucleotide
gaagtgcaactccaacagtcaggcgcagaagtcaagaagcccggatcgtcagtgaaagtgtcctgcaaagcctccggcggaaccttcagctcctacgcaatcagctgggtgcggcaggcgcccggacagggactggagtggatgggcggtatcattccgatctttggcaccgccaattacgcccagaagttccagggacgcgtcacaatcaccgccgacgaatcgacttccaccgcctacatggagctgtcgtccttgaggagcgaagataccgccgtgtactactgcgctcgggatctggagatggccactatcatggggggttactggggccaggggaccctggtcactgtgtcctcgggaggagggggatcaggcggcggcggttccgggggaggaggaagccagtccgcgctgactcagccagcttccgtgtctggttcgccgggacagtccatcactattagctgtaccggcaccagcagcgacgtgggcggctacaactatgtgtcatggtaccagcagcacccggggaaggcgcctaagctgatgatctacgacgtgtccaaccgccctagcggagtgtccaacagattctccggttcgaagtcagggaacactgcctccctcacgattagcgggctgcaagccgaggatgaagccgactactactgctcctcctatacctcctcctcgaccctggacgtggtgttcggaggaggcaccaagctcaccgtcctt

SEQ ID NO: 892 - protein, 120 aa, Artificial Sequence
  Description of Artificial Sequence: Synthetic polypeptide
EVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSS

SEQ ID NO: 893 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVL

SEQ ID NO: 894 - protein, 491 aa, Artificial Sequence
  Description of Artificial Sequence: Synthetic polypeptide
MALPVTALLLPLALLLHAARPEVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 895 - DNA, 1473 bp, Artificial Sequence
  Description of Artificial Sequence: Synthetic polynucleotide
atggccctccctgtcaccgccctgctgcttccgctggctcttctgctccacgccgctcggcccgaagtgcaactccaacagtcaggcgcagaagtcaagaagcccggatcgtcagtgaaagtgtcctgcaaagcctccggcggaaccttcagctcctacgcaatcagctgggtgcggcaggcgcccggacagggactggagtggatgggcggtatcattccgatctttggcaccgccaattacgcccagaagttccagggacgcgtcacaatcaccgccgacgaatcgacttccaccgcctacatggagctgtcgtccttgaggagcgaagataccgccgtgtactactgcgctcgggatctggagatggccactatcatggggggttactggggccaggggaccctggtcactgtgtcctcgggaggagggggatcaggcggcggcggttccgggggaggaggaagccagtccgcgctgactcagccagcttccgtgtctggttcgccgggacagtccatcactattagctgtaccggcaccagcagcgacgtgggcggctacaactatgtgtcatggtaccagcagcacccggggaaggcgcctaagctgatgatctacgacgtgtccaaccgccctagcggagtgtccaacagattctccggttcgaagtcagggaacactgcctccctcacgattagcgggctgcaagccgaggatgaagccgactactactgctcctcctatacctcctcctcgaccctggacgtggtgttcggaggaggcaccaagctcaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 896 - protein, 245 aa, Artificial Sequence
  Description of Artificial Sequence: Synthetic polypeptide
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIK

SEQ ID NO: 897 - DNA, 735 bp, Artificial Sequence
  Description of Artificial Sequence: Synthetic polynucleotide
gaagtgcaattggtggaaagcggaggaggagtggtgcaacctggaggaagcctgagactgtcatgtgccgcctcgggattcactttcgatgactacgcaatgcactgggtccgccaggcccccggaaagggtctggaatgggtgtccctcatctccggcgatgggggttccacttactatgcggattctgtgaagggccgcttcacaatctcccgggacaattccaagaacactctgtaccttcaaatgaactccctgagggtggaggacaccgctgtgtactactgcgcgagagtgtttgactcgtactatatggacgtctggggaaagggcaccaccgtgaccgtgtccagcggtggcggtggatcggggggcggcggctccgggagcggaggttccgagattgtgctgactcagtcgccgttgtcactgcctgtcacccccgggcagccggcctccatttcatgccggtccagccagtccctggtctacaccgatgggaacacttacctcaactggttccagcagcgcccaggacagtccccgcggaggctgatctacaaagtgtcaaaccgggactccggcgtccccgatcggttctcgggaagcggcagcgacaccgacttcacgctgaagatttcccgcgtggaagccgaggacgtgggcatctactactgtatgcagggcacccactggtcgtttaccttcggacaaggaactaggctcgagatcaag

SEQ ID NO: 898 - protein, 118 aa, Artificial Sequence
  Description of Artificial Sequence: Synthetic polypeptide
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSS

SEQ ID NO: 899 - protein, 112 aa, Artificial Sequence
  Description of Artificial Sequence: Synthetic polypeptide
EIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIK

SEQ ID NO: 900 - protein, 489 aa, Artificial Sequence
  Description of Artificial Sequence: Synthetic polypeptide
MALPVTALLLPLALLLHAARPEVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 901 - DNA, 1467 bp, Artificial Sequence
  Description of Artificial Sequence: Synthetic polynucleotide
atggccctccctgtcaccgccctgctgcttccgctggctcttctgctccacgccgctcggcccgaagtgcaattggtggaaagcggaggaggagtggtgcaacctggaggaagcctgagactgtcatgtgccgcctcgggattcactttcgatgactacgcaatgcactgggtccgccaggcccccggaaagggtctggaatgggtgtccctcatctccggcgatgggggttccacttactatgcggattctgtgaagggccgcttcacaatctcccgggacaattccaagaacactctgtaccttcaaatgaactccctgagggtggaggacaccgctgtgtactactgcgcgagagtgtttgactcgtactatatggacgtctggggaaagggcaccaccgtgaccgtgtccagcggtggcggtggatcggggggcggcggctccgggagcggaggttccgagattgtgctgactcagtcgccgttgtcactgcctgtcacccccgggcagccggcctccatttcatgccggtccagccagtccctggtctacaccgatgggaacacttacctcaactggttccagcagcgcccaggacagtccccgcggaggctgatctacaaagtgtcaaaccgggactccggcgtccccgatcggttctcgggaagcggcagcgacaccgacttcacgctgaagatttcccgcgtggaagccgaggacgtgggcatctactactgtatgcagggcacccactggtcgtttaccttcggacaaggaactaggctcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 902 - protein, 247 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSSGGGGSGGGGSGGGGSDIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIK

SEQ ID NO: 903 - DNA, 741 bp, Artificial Sequence
  Description of Artificial Sequence: Synthetic polynucleotide
caagtgcagcttcaagaaagcggtccaggactcgtcaagccatcagaaactctttccctcacttgtaccgtgtcgggaggcagcatctcctcgagctcctactactggggttggattagacagcccccgggaaaggggttggagtggatcggttccatctactactccgggtcgacctactacaacccttccctgaaatctcgggtgtccatctccgtcgacacctccaagaaccagttcagcctgaagctgaaatatgtgaccgcggccgatactgccgtgtactattgcgccaccccgggaacctactacgacttcctctcggggtactacccgttttactggggacaggggactctcgtgaccgtgtcctcgggcggcggaggttcaggcggtggcggatcggggggaggaggctcagacattgtgatgacccagagcccgtccagcctgagcgcctccgtgggcgatagggtcacgattacttgccgggcgtcccagggaatctcaagctacctggcctggtaccaacagaagcccggaaaggcacccaagttgctgatctatgccgctagcactctgcagtccggggtgccttcccgcttctccggctccggctcgggcaccgacttcaccctgaccatttcctcactgcaacccgaggacttcgccacttactactgccagcagctgaactcctacccttacacattcggacagggaaccaagctggaaatcaag

SEQ ID NO: 904 - protein, 125 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSS

SEQ ID NO: 905 - protein, 107 aa, Artificial Sequence
  Description of Artificial Sequence: Synthetic polypeptide
DIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIK

SEQ ID NO: 906 - protein, 491 aa, Artificial Sequence
  Description of Artificial Sequence: Synthetic polypeptide
MALPVTALLLPLALLLHAARPQVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSSGGGGSGGGGSGGGGSDIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 907 - DNA, 1473 bp, Artificial Sequence
  Description of Artificial Sequence: Synthetic polynucleotide
atggccctccctgtcaccgccctgctgcttccgctggctcttctgctccacgccgctcggccccaagtgcagcttcaagaaagcggtccaggactcgtcaagccatcagaaactctttccctcacttgtaccgtgtcgggaggcagcatctcctcgagctcctactactggggttggattagacagcccccgggaaaggggttggagtggatcggttccatctactactccgggtcgacctactacaacccttccctgaaatctcgggtgtccatctccgtcgacacctccaagaaccagttcagcctgaagctgaaatatgtgaccgcggccgatactgccgtgtactattgcgccaccccgggaacctactacgacttcctctcggggtactacccgttttactggggacaggggactctcgtgaccgtgtcctcgggcggcggaggttcaggcggtggcggatcggggggaggaggctcagacattgtgatgacccagagcccgtccagcctgagcgcctccgtgggcgatagggtcacgattacttgccgggcgtcccagggaatctcaagctacctggcctggtaccaacagaagcccggaaaggcacccaagttgctgatctatgccgctagcactctgcagtccggggtgccttcccgcttctccggctccggctcgggcaccgacttcaccctgaccatttcctcactgcaacccgaggacttcgccacttactactgccagcagctgaactcctacccttacacattcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 908 - protein, 239 aa, Artificial Sequence
  Description of Artificial Sequence: Synthetic polypeptide
QVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSSGGGGSGGGGSGGGGSEIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIK

SEQ ID NO: 909 - DNA, 717 bp, Artificial Sequence
  Description of Artificial Sequence: Synthetic polynucleotide
caagtgcaactcgtggaatctggtggaggactcgtgcaacccggaggatcattgcgactctcgtgtgcggcatccggctttaccttttcatcctactggatgtcctgggtcagacaggcccccgggaagggactggaatgggtcgcgaacatcaacgaggacggctcggccaagttctacgtggactccgtgaagggccgcttcacgatctcacgggataacgccaagaattccctgtatctgcaaatgaacagcctgagggccgaggacactgcggtgtacttctgcgcacgcgacctgaggtccgggagatactggggacagggcaccctcgtgaccgtgtcgagcggaggaggggggtcgggcggcggcggttccggtggcggcggtagcgaaattgtgttgacccagtcccctggaaccctgagcctgtcacctggaggacgcgccaccctgtcctgccgggccagccagagcatctcagggtccttcctggcttggtaccagcagaagccgggacaggctccgagacttctgatctacggcgcctcctcgcgggcgaccggaatcccggatcggttctccggctcgggaagcggaactgacttcactcttaccatttcccgcctggagccggaagatttcgccgtgtactactgccagcagtacgggtcatcccctccaaccttcggcctgggaactaagctggaaatcaaa

SEQ ID NO: 910 - protein, 116 aa, Artificial Sequence
  Description of Artificial Sequence: Synthetic polypeptide
QVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSS

SEQ ID NO: 911 - protein, 108 aa, Artificial Sequence
  Description of Artificial Sequence: Synthetic polypeptide
EIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIK

SEQ ID NO: 912 - protein, 483 aa, Artificial Sequence
  Description of Artificial Sequence: Synthetic polypeptide
MALPVTALLLPLALLLHAARPQVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSSGGGGSGGGGSGGGGSEIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 913 - DNA, 1449 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatctggtggaggactcgtgcaacccggaggatcattgcgactctcgtgtgcggcatccggctttaccttttcatcctactggatgtcctgggtcagacaggcccccgggaagggactggaatgggtcgcgaacatcaacgaggacggctcggccaagttctacgtggactccgtgaagggccgcttcacgatctcacgggataacgccaagaattccctgtatctgcaaatgaacagcctgagggccgaggacactgcggtgtacttctgcgcacgcgacctgaggtccgggagatactggggacagggcaccctcgtgaccgtgtcgagcggaggaggggggtcgggcggcggcggttccggtggcggcggtagcgaaattgtgttgacccagtcccctggaaccctgagcctgtcacctggaggacgcgccaccctgtcctgccgggccagccagagcatctcagggtccttcctggcttggtaccagcagaagccgggacaggctccgagacttctgatctacggcgcctcctcgcgggcgaccggaatcccggatcggttctccggctcgggaagcggaactgacttcactcttaccatttcccgcctggagccggaagatttcgccgtgtactactgccagcagtacgggtcatcccctccaaccttcggcctgggaactaagctggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 914 - protein, 245 aa, Artificial Sequence
  Description of Artificial Sequence: Synthetic polypeptide
EVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSSGGGGSGGGGSGSGGSDIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 915 - DNA, 735 bp, Artificial Sequence
  Description of Artificial Sequence: Synthetic polynucleotide
gaagtgcaactccaacaatccggtccaggactcgtcagaccctccgaaactctctcgcttacatgcactgtgtccggcggccctgtgcggtccggctctcattactggaactggattcgccagcccccgggacgcggactggagtggatcggctacatctattactcggggtcgactaactacaacccgagcctggaaaatagagtgaccatctcaatcgacacgtccaacaaccacttctcgctgaagttgtcctccgtgactgccgccgatactgccctgtacttctgtgctcgcggaaccgccaccttcgactggaacttcccttttgactcatggggccaggggacccttgtgaccgtgtccagcggaggaggaggctccggtggtggcgggagcggtagcggcggaagcgacatccagatgacccagtcaccgtcctcgctgtccgcatccattggggatcgggtcactattacttgccgggcgtcccagtccatctcgtcctacctgaactggtatcagcagaagccagggaaagcccccaagctgctgatctacgcggccagcagcctgcagtcaggagtgccttcaaggtttagcggcagcggatcgggaaccgacttcaccctgaccatttcctccctccaacccgaggatttcgccacctactactgccagcagtcctactccaccccgtggaccttcggacagggaaccaagctggagatcaag

SEQ ID NO: 916 - protein, 123 aa, Artificial Sequence
  Description of Artificial Sequence: Synthetic polypeptide
EVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSS

SEQ ID NO: 917 - protein, 107 aa, Artificial Sequence
  Description of Artificial Sequence: Synthetic polypeptide
DIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 918 - protein, 489 aa, Artificial Sequence
  Description of Artificial Sequence: Synthetic polypeptide
MALPVTALLLPLALLLHAARPEVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSSGGGGSGGGGSGSGGSDIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 919 - DNA, 1467 bp, Artificial Sequence
  Description of Artificial Sequence: Synthetic polynucleotide
atggccctccctgtcaccgccctgctgcttccgctggctcttctgctccacgccgctcggcccgaagtgcaactccaacaatccggtccaggactcgtcagaccctccgaaactctctcgcttacatgcactgtgtccggcggccctgtgcggtccggctctcattactggaactggattcgccagcccccgggacgcggactggagtggatcggctacatctattactcggggtcgactaactacaacccgagcctggaaaatagagtgaccatctcaatcgacacgtccaacaaccacttctcgctgaagttgtcctccgtgactgccgccgatactgccctgtacttctgtgctcgcggaaccgccaccttcgactggaacttcccttttgactcatggggccaggggacccttgtgaccgtgtccagcggaggaggaggctccggtggtggcgggagcggtagcggcggaagcgacatccagatgacccagtcaccgtcctcgctgtccgcatccattggggatcgggtcactattacttgccgggcgtcccagtccatctcgtcctacctgaactggtatcagcagaagccagggaaagcccccaagctgctgatctacgcggccagcagcctgcagtcaggagtgccttcaaggtttagcggcagcggatcgggaaccgacttcaccctgaccatttcctccctccaacccgaggatttcgccacctactactgccagcagtcctactccaccccgtggaccttcggacagggaaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 920 - protein, 255 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 921 - DNA, 765 bp, Artificial Sequence
  Description of Artificial Sequence: Synthetic polynucleotide
gaagtgcaattggtggaatctggaggaggacttgtgaaacctggtggaagcctgagactttcctgtgcggcctcgggattcactttctcctcctactccatgaactgggtcagacaggcccctgggaagggactggaatgggtgtcatccatctcctcctcatcgtcgtacatctactacgccgatagcgtgaaggggcggttcaccatttcccgggacaacgctaagaacagcctctatctgcaaatgaattccctccgcgccgaggacactgccgtgtactactgcgcgagggacccctcatcaagcggcagctactacatggaggactcgtattactacggaatggacgtctggggccagggaaccactgtgacggtgtcctccggtggagggggctccgggggcgggggatctggcggaggaggctccaacttcatgctgacccagccgcactccgtgtccgaaagccccggaaagaccgtgacaatttcctgcaccgggtcctccggctcgatcgcatcaaactacgtgcagtggtaccagcagcgcccgggcagcgcccccaccactgtcatctacgaggataaccagcggccgtcgggtgtcccagaccggttttccggttcgatcgatagcagcagcaacagcgcctccctgaccatttccggcctcaagaccgaggatgaggctgactactactgccagtcgtatgactcctcgaaccaagtggtgttcggtggcggcaccaagctgactgtgctg

SEQ ID NO: 922 - protein, 129 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSS

SEQ ID NO: 923 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 924 - protein, 499 aa, Artificial Sequence
  Description of Artificial Sequence: Synthetic polypeptide
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 925 - DNA, 1497 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatctggaggaggacttgtgaaacctggtggaagcctgagactttcctgtgcggcctcgggattcactttctcctcctactccatgaactgggtcagacaggcccctgggaagggactggaatgggtgtcatccatctcctcctcatcgtcgtacatctactacgccgatagcgtgaaggggcggttcaccatttcccgggacaacgctaagaacagcctctatctgcaaatgaattccctccgcgccgaggacactgccgtgtactactgcgcgagggacccctcatcaagcggcagctactacatggaggactcgtattactacggaatggacgtctggggccagggaaccactgtgacggtgtcctccggtggagggggctccgggggcgggggatctggcggaggaggctccaacttcatgctgacccagccgcactccgtgtccgaaagccccggaaagaccgtgacaatttcctgcaccgggtcctccggctcgatcgcatcaaactacgtgcagtggtaccagcagcgcccgggcagcgcccccaccactgtcatctacgaggataaccagcggccgtcgggtgtcccagaccggttttccggttcgatcgatagcagcagcaacagcgcctccctgaccatttccggcctcaagaccgaggatgaggctgactactactgccagtcgtatgactcctcgaaccaagtggtgttcggtggcggcaccaagctgactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 926 - protein, 239 aa, Artificial Sequence
  Description of Artificial Sequence: Synthetic polypeptide
QVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIK

SEQ ID NO: 927 - DNA, 717 bp, Artificial Sequence
  Description of Artificial Sequence: Synthetic polynucleotide
caagtgaacctgagagaaagcggcggaggacttgtgcaacctggaggaagcctgagactgtcatgtgccgcgtccggcttcaccttctcgtcctacgagatgaactgggtccgccaggcaccgggcaaaggactggaatgggtgtcctacatttcctcgtccgggtccaccatctattacgccgactccgtgaagggacggttcaccatctcccgggacaacgccaagaactccctctacctccaaatgaactcactgagggcagaggacactgcggtctactactgcgcccgcgaagctttgggtagctcctgggagtggggccagggaaccactgtgaccgtgtcctcgggtggagggggctccggtggcgggggttcagggggtggcggaagcgatatccagatgactcagtcaccaagctccctgagcgcctcagtgggagatcgggtcacaatcacgtgccaggcgtcccaggacatttctaactacctcaattggtaccagcagaagccggggaaggcccccaagcttctgatctacgatgcctccaacctggaaaccggcgtgccctcccgcttctcgggatcgggcagcggcactgacttcacctttaccatctcgtccctgcaacctgaggacatcgccacctattactgccagcagtacgataacctcccgctgactttcggaggcggaactaagctggagattaag

SEQ ID NO: 928 - protein, 117 aa, Artificial Sequence
  Description of Artificial Sequence: Synthetic polypeptide
QVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSS

SEQ ID NO: 929 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIK

SEQ ID NO: 930 - protein, 483 aa, Artificial Sequence
  Description of Artificial Sequence: Synthetic polypeptide
MALPVTALLLPLALLLHAARPQVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 931 - DNA, 1449 bp, Artificial Sequence
  Description of Artificial Sequence: Synthetic polynucleotide
atggccctccctgtcaccgccctgctgcttccgctggctcttctgctccacgccgctcggccccaagtgaacctgagagaaagcggcggaggacttgtgcaacctggaggaagcctgagactgtcatgtgccgcgtccggcttcaccttctcgtcctacgagatgaactgggtccgccaggcaccgggcaaaggactggaatgggtgtcctacatttcctcgtccgggtccaccatctattacgccgactccgtgaagggacggttcaccatctcccgggacaacgccaagaactccctctacctccaaatgaactcactgagggcagaggacactgcggtctactactgcgcccgcgaagctttgggtagctcctgggagtggggccagggaaccactgtgaccgtgtcctcgggtggagggggctccggtggcgggggttcagggggtggcggaagcgatatccagatgactcagtcaccaagctccctgagcgcctcagtgggagatcgggtcacaatcacgtgccaggcgtcccaggacatttctaactacctcaattggtaccagcagaagccggggaaggcccccaagcttctgatctacgatgcctccaacctggaaaccggcgtgccctcccgcttctcgggatcgggcagcggcactgacttcacctttaccatctcgtccctgcaacctgaggacatcgccacctattactgccagcagtacgataacctcccgctgactttcggaggcggaactaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 932 - protein, 247 aa, Artificial Sequence
  Description of Artificial Sequence: Synthetic polypeptide
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIK

SEQ ID NO: 933 - DNA, 741 bp, Artificial Sequence
  Description of Artificial Sequence: Synthetic polynucleotide
caagtgcaactcgtccagtccggtgcagaagtgaaaaagagcggagcctcagtgaaagtgtcctgcaaggcctccggttaccccttcactggatactacattcagtgggtccgccaagccccgggacagggtctggagtggatggggtggattgaccctaactcgggaaatacgggatacgcgcagaagttccagggccgcgtgaccatgaccaggaacacctcgatcagcaccgcctacatggaactgtcctccctgcggtcggaggatactgccgtgtactactgcgcctccgattcctatgggtactactacggaatggacgtctggggacagggcaccctcgtgaccgtgtcctcgggaggcggagggagcggcgggggtggatcgggaggaggcggctccggcggcggcggtagcgacatccagatgacccagtcaccatcaagccttagcgcctccgtgggcgacagagtgacattcacttgtcgggcgtcccagggaatctcctccgctctggcttggtatcagcagaagcctgggaagcctccgaagctgttgatctacgacgcgagcagcctggaatcaggggtgccctcccggttttccgggtccggttctggcaccgatttcaccctgaccatttcgtccctccaacccgaggacttcgccacttactactgccagcagttcaacaactacccgctgaccttcggaggaggcactaaggtcgagatcaag

SEQ ID NO: 934 - protein, 120 aa, Artificial Sequence
  Description of Artificial Sequence: Synthetic polypeptide
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSS

SEQ ID NO: 935 - protein, 107 aa, Artificial Sequence
  Description of Artificial Sequence: Synthetic polypeptide
DIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIK

SEQ ID NO: 936 - protein, 491 aa, Artificial Sequence
  Description of Artificial Sequence: Synthetic polypeptide
MALPVTALLLPLALLLHAARPQVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 937 - DNA, 1473 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtgaaaaagagcggagcctcagtgaaagtgtcctgcaaggcctccggttaccccttcactggatactacattcagtgggtccgccaagccccgggacagggtctggagtggatggggtggattgaccctaactcgggaaatacgggatacgcgcagaagttccagggccgcgtgaccatgaccaggaacacctcgatcagcaccgcctacatggaactgtcctccctgcggtcggaggatactgccgtgtactactgcgcctccgattcctatgggtactactacggaatggacgtctggggacagggcaccctcgtgaccgtgtcctcgggaggcggagggagcggcgggggtggatcgggaggaggcggctccggcggcggcggtagcgacatccagatgacccagtcaccatcaagccttagcgcctccgtgggcgacagagtgacattcacttgtcgggcgtcccagggaatctcctccgctctggcttggtatcagcagaagcctgggaagcctccgaagctgttgatctacgacgcgagcagcctggaatcaggggtgccctcccggttttccgggtccggttctggcaccgatttcaccctgaccatttcgtccctccaacccgaggacttcgccacttactactgccagcagttcaacaactacccgctgaccttcggaggaggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 938 - protein, 122 aa, Artificial Sequence
  Description of Artificial Sequence: Synthetic polypeptide
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSS

SEQ ID NO: 939 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIK

SEQ ID NO: 940 - protein, 489 aa, Artificial Sequence
  Description of Artificial Sequence: Synthetic polypeptide
MALPVTALLLPLALLLHAARPEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 941 - DNA, 1467 bp, Artificial Sequence
  Description of Artificial Sequence: Synthetic polynucleotide
atggccctccctgtcaccgccctgctgcttccgctggctcttctgctccacgccgctcggcccgaagtgcaactcgtggaaagcggtggaggtcttgtgcaacctggaggttccttgcgcctgtcatgtgcagcttccggcttcactttctcctcgtacgagatgaattgggtgcggcaggcgcctggaaaggggctggaatgggtgtcctacatctcaagctccggctcgaccatctactacgcggacagcgtgaaggggcggttcacgatttcgagggacaacgccaagaactcgctctatctgcaaatgaactccctgagagccgaggacaccgctgtgtattactgcgcccgggacccctactcctcctcatggcacgacgcctttgatatctggggccagggaaccatggtcaccgtcagcagcgggggcggaggttccgggggagggggctccggcggaggaggctccgagattgtgttgactcagagcccgggtaccctgtcgctgagccccggagagcgggccaccctttcatgccgcgccagccagtccgtgtcctcatcctacctcgcgtggtaccagcagaaacctggccaggccccgcggctgctgatctacggcgcctcctcgcgcgcaaccggaatccccgaccggttctccgggtctggcagcggaaccgacttcactctcaccatttcgaggctggagccggaagatttcgccgtgtactactgccagcagtacggctcctcgccactgactttcggcggaggaaccaaggtcgatatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 942 - DNA, 354 bp, Artificial Sequence
  Description of Artificial Sequence: Synthetic polynucleotide
gagcagctgaaggagtccgggggaggtctcttcaagccaacggataccctgacactcacctgcacagtctctggattctccctcagttactatggagtgaactgggtccgccaggctccagggaacgggctggaatggatcggaaccattggtggtagtggtgacacatactacgcgagctgggcgaagagccgatccaccatcatcagaaacaccaacgagaacacggtgactctgaaaatgaccagtctgacagccgcggacacggccacctatttctgtgtgagatatgctaatattggttatgagtactttaacgtctggggtccaggcaccctggtcaccgtctcttca

SEQ ID NO: 943 - protein, 118 aa, Artificial Sequence
  Description of Artificial Sequence: Synthetic polypeptide
EQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSS

SEQ ID NO: 944 - DNA, 24 bp, Artificial Sequence
  Description of Artificial Sequence: Synthetic oligonucleotide
ggattctccctcagttactatgga

SEQ ID NO: 945 - protein, 8 aa, Artificial Sequence
  Description of Artificial Sequence: Synthetic peptide
GFSLSYYG

SEQ ID NO: 946 - DNA, 21 bp, Artificial Sequence
  Description of Artificial Sequence: Synthetic oligonucleotide
attggtggtagtggtgacaca

SEQ ID NO: 947 - protein, 7 aa, Artificial Sequence
  Description of Artificial Sequence: Synthetic peptide
IGGSGDT

SEQ ID NO: 948 - DNA, 39 bp, Artificial Sequence
  Description of Artificial Sequence: Synthetic oligonucleotide
gtgagatatgctaatattggttatgagtactttaacgtc

SEQ ID NO: 949 - protein, 13 aa, Artificial Sequence
  Description of Artificial Sequence: Synthetic peptide
VRYANIGYEYFNV

SEQ ID NO: 950 - DNA, 333 bp, Artificial Sequence
  Description of Artificial Sequence: Synthetic polynucleotide
cagtttgtgctgactcagtcgccctctgcatctgctgccctgggagcctcggccaagctcacctgcaccctgagcagtgcccacaagacctacaccattgactggtatcagcagcagaaagggaaggcccctcgctacctgatacaagttaagagtgatggaacctacaccaaggcgaccggggtccctgatcgcttctcgggctccagctctggggctgaccgctacctgatcatccccagcgtccaggctgatgacgaagccgactactattgtggtacagattataccggtgggtatgtgttcggcggggggacccagctgaccgtcaca

SEQ ID NO: 951 - protein, 111 aa, Artificial Sequence
  Description of Artificial Sequence: Synthetic polypeptide
QFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVT

SEQ ID NO: 952 - DNA, 21 bp, Artificial Sequence
  Description of Artificial Sequence: Synthetic oligonucleotide
agtgcccacaagacctacacc

SEQ ID NO: 953 - protein, 7 aa, Artificial Sequence
  Description of Artificial Sequence: Synthetic peptide
SAHKTYT

SEQ ID NO: 954 - DNA, 21 bp, Artificial Sequence
  Description of Artificial Sequence: Synthetic oligonucleotide
gttaagagtgatggaacctac

SEQ ID NO: 955 - protein, 7 aa, Artificial Sequence
  Description of Artificial Sequence: Synthetic peptide
VKSDGTY

SEQ ID NO: 956 - DNA, 27 bp, Artificial Sequence
  Description of Artificial Sequence: Synthetic oligonucleotide
ggtacagattataccggtgggtatgtg

SEQ ID NO: 957 - protein, 9 aa, Artificial Sequence
  Description of Artificial Sequence: Synthetic peptide
GTDYTGGYV

SEQ ID NO: 958 - DNA, 744 bp, Artificial Sequence
  Description of Artificial Sequence: Synthetic polynucleotide
ggatccgagcagctgaaggagtccgggggaggtctcttcaagccaacggataccctgacactcacctgcacagtctctggattctccctcagttactatggagtgaactgggtccgccaggctccagggaacgggctggaatggatcggaaccattggtggtagtggtgacacatactacgcgagctgggcgaagagccgatccaccatcatcagaaacaccaacgagaacacggtgactctgaaaatgaccagtctgacagccgcggacacggccacctatttctgtgtgagatatgctaatattggttatgagtactttaacgtctggggtccaggcaccctggtcaccgtctcttcaggtggaggcggttcaggcggcggtggctctagcggtggtggatcgcagtttgtgctgactcagtcgccctctgcatctgctgccctgggagcctcggccaagctcacctgcaccctgagcagtgcccacaagacctacaccattgactggtatcagcagcagaaagggaaggcccctcgctacctgatacaagttaagagtgatggaacctacaccaaggcgaccggggtccctgatcgcttctcgggctccagctctggggctgaccgctacctgatcatccccagcgtccaggctgatgacgaagccgactactattgtggtacagattataccggtgggtatgtgttcggcggggggacccagctgaccgtcacagctagc

SEQ ID NO: 959 - DNA, 744 bp, Artificial Sequence
  Description of Artificial Sequence: Synthetic polynucleotide
ggatccgagcagctgaaggagtccggcggaggcctgtttaagcccaccgacaccctgacactgacctgcacagtgtccggcttcagcctgagctactatggcgtgaactgggtgagacaggcccctggcaacggactggagtggatcggcaccattggcggcagcggagacacctactacgccagctgggccaagtccaggagcaccatcatcagaaacaccaacgagaacaccgtgaccctgaagatgacctccctgacagccgccgacaccgccacctacttctgcgtgaggtacgccaacatcggctacgagtacttcaacgtgtggggccctggcaccctggtgacagtgtccagcggcggaggaggaagcggcggcggcggctccagcggaggcggcagccagtttgtgctgacccagagccctagcgcttccgccgccctgggcgccagcgccaagctcacctgtaccctgagcagcgcccacaagacctataccatcgactggtaccagcagcagaagggcaaggcccccaggtacctgatccaggtgaagtccgacggcacctacaccaaagccaccggcgtgcccgacagatttagcggcagcagctccggcgccgacaggtatctgatcatcccttccgtgcaggccgacgacgaggccgactactactgcggaaccgactacaccggcggatacgtgttcggaggcggcacccagctgaccgtgaccgctagc

SEQ ID NO: 960 - protein, 248 aa, Artificial Sequence
  Description of Artificial Sequence: Synthetic polypeptide
GSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSGGGGSGGGGSSGGGSQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTAS

SEQ ID NO: 961 - protein, 244 aa, Artificial Sequence
  Description of Artificial Sequence: Synthetic polypeptide
EQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSGGGGSGGGGSSGGGSQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVT

SEQ ID NO: 962 - DNA, 369 bp, Artificial Sequence
  Description of Artificial Sequence: Synthetic polynucleotide
cagtcagtgaaggagtccgagggaggtctcttcaagccaacggataccctgacactcacctgcacggtctctggattctccctcagtagacatgcactgacctgggtccgccaggctccagggaacgggctggaatggatcggagccattgataacgctggtaccacatactacgcgagctgggcgaaaagccgctccaccatcaccagaaacaccgacctgcacacggtgactctgaaaatgaccagtctgacagcctcggacacggctacctatttctgtgcgagagtcttttatgatattaatagtggttattatctggacggcatggacctctggggcccagggaccctcgtcaccgtctcttca

SEQ ID NO: 963 - protein, 123 aa, Artificial Sequence
  Description of Artificial Sequence: Synthetic polypeptide
QSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSS

SEQ ID NO: 964 - DNA, 24 bp, Artificial Sequence
  Description of Artificial Sequence: Synthetic oligonucleotide
ggattctccctcagtagacatgca

SEQ ID NO: 965 - protein, 8 aa, Artificial Sequence
  Description of Artificial Sequence: Synthetic peptide
GFSLSRHA

SEQ ID NO: 966 - DNA, 21 bp, Artificial Sequence
  Description of Artificial Sequence: Synthetic oligonucleotide
attgataacgctggtaccaca

SEQ ID NO: 967 - protein, 7 aa, Artificial Sequence
  Description of Artificial Sequence: Synthetic peptide
IDNAGTT

SEQ ID NO: 968 - DNA, 54 bp, Artificial Sequence
  Description of Artificial Sequence: Synthetic oligonucleotide
gcgagagtcttttatgatattaatagtggttattatctggacggcatggacctc

SEQ ID NO: 969 - protein, 18 aa, Artificial Sequence
  Description of Artificial Sequence: Synthetic peptide
ARVFYDINSGYYLDGMDL

SEQ ID NO: 970 - DNA, 333 bp, Artificial Sequence
  Description of Artificial Sequence: Synthetic polynucleotide
cagtttgtgctgactcagtcgccctctgtgtctgccgccctgggagcctctgccaagctcacctgcaccctgagcagtgcccacaagacctacaccattgactggtatcagcagcagcaaggggaggcccctcggtacctgatgcaagttaagagtgatggaagctacaccaaggggaccggggtccctgatcgcttctcgggctccagctctggggctgaccgctacttgatcatccccagcgtccaggctgatgacgaagccggctacgtttgtggtgcagatgataacggtgggtatgtgttcggcggagggacccagctgaccgtcaca

SEQ ID NO: 971 - protein, 111 aa, Artificial Sequence
  Description of Artificial Sequence: Synthetic polypeptide
QFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVT

SEQ ID NO: 972 - DNA, 21 bp, Artificial Sequence
  Description of Artificial Sequence: Synthetic oligonucleotide
agtgcccacaagacctacacc

SEQ ID NO: 973 - protein, 7 aa, Artificial Sequence
  Description of Artificial Sequence: Synthetic peptide
SAHKTYT

SEQ ID NO: 974 - DNA, 21 bp, Artificial Sequence
  Description of Artificial Sequence: Synthetic oligonucleotide
gttaagagtgatggaagctac

SEQ ID NO: 975 - protein, 7 aa, Artificial Sequence
  Description of Artificial Sequence: Synthetic peptide
VKSDGSY

SEQ ID NO: 976 - DNA, 27 bp, Artificial Sequence
  Description of Artificial Sequence: Synthetic oligonucleotide
ggtgcagatgataacggtgggtatgtg

SEQ ID NO: 977 - protein, 9 aa, Artificial Sequence
  Description of Artificial Sequence: Synthetic peptide
GADDNGGYV

SEQ ID NO: 978 - DNA, 759 bp, Artificial Sequence
  Description of Artificial Sequence: Synthetic polynucleotide
ggatcccagtcagtgaaggagtccgagggaggtctcttcaagccaacggataccctgacactcacctgcacggtctctggattctccctcagtagacatgcactgacctgggtccgccaggctccagggaacgggctggaatggatcggagccattgataacgctggtaccacatactacgcgagctgggcgaaaagccgctccaccatcaccagaaacaccgacctgcacacggtgactctgaaaatgaccagtctgacagcctcggacacggctacctatttctgtgcgagagtcttttatgatattaatagtggttattatctggacggcatggacctctggggcccagggaccctcgtcaccgtctcttcaggtggaggcggttcaggcggcggtggctctagcggtggtggatcgcagtttgtgctgactcagtcgccctctgtgtctgccgccctgggagcctctgccaagctcacctgcaccctgagcagtgcccacaagacctacaccattgactggtatcagcagcagcaaggggaggcccctcggtacctgatgcaagttaagagtgatggaagctacaccaaggggaccggggtccctgatcgcttctcgggctccagctctggggctgaccgctacttgatcatccccagcgtccaggctgatgacgaagccggctacgtttgtggtgcagatgataacggtgggtatgtgttcggcggagggacccagctgaccgtcacagctagc

SEQ ID NO: 979 - DNA, 759 bp, Artificial Sequence
  Description of Artificial Sequence: Synthetic polynucleotide
ggatcccagtccgtgaaggagagcgagggcggcctgttcaagcccaccgacaccctgaccctgacctgcacagtgagcggcttcagcctgtccagacacgccctgacatgggtgagacaggcccctggcaacggcctggaatggatcggcgccatcgacaacgccggcaccacctactacgccagctgggccaagtccaggtccaccatcaccaggaacaccgacctccacaccgtgaccctgaagatgacaagcctgaccgcctccgacaccgccacctacttctgcgccagggtgttctacgacatcaacagcggctactacctggatggcatggacctgtggggacctggcacactggtgaccgtgagcagcggaggcggcggcagcggcggcggcggcagcagcggcggcggaagccagttcgtgctgacacagagccctagcgtgagcgccgccctgggagcctccgctaaactgacctgcaccctgagcagcgcccacaagacctacaccatcgactggtaccaacagcagcagggcgaggcccccaggtatctgatgcaggtgaagtccgacggcagctacaccaaaggcaccggcgtgcctgacaggttcagcggcagctccagcggagccgacaggtacctgatcatcccctccgtgcaggccgacgacgaggctggctacgtgtgtggcgccgacgacaatggcggctacgtgttcggaggcggcacccagctgaccgtgacagctagc

SEQ ID NO: 980 - protein, 253 aa, Artificial Sequence
  Description of Artificial Sequence: Synthetic polypeptide
GSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSGGGGSGGGGSSGGGSQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTAS

SEQ ID NO: 981 - protein, 249 aa, Artificial Sequence
  Description of Artificial Sequence: Synthetic polypeptide
QSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSGGGGSGGGGSSGGGSQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVT

SEQ ID NO: 982 - DNA, 521 bp, Homo sapiens
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 983 - DNA, 118 bp, Homo sapiens
acccctctctccagccactaagccagttgctccctcggctgacggctgcacgcgaggcctccgaacgtcttacgccttgtggcgcgcccgtccttgtcccgggtgtgatggcggggtg

SEQ ID NO: 984 - DNA, 221 bp, Homo sapiens
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 985 - DNA, 324 bp, Homo sapiens
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 986 - DNA, 422 bp, Homo sapiens
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

What is claimed is:

1. A method of expanding and/or activating a population of immune cells, comprising:
providing a first CAR-expressing cell population, said first CAR-expressing cell population comprising a transiently expressed first CAR molecule, and said CAR molecule comprises an antigen binding domain of an antibody molecule; and
contacting said first CAR-expressing cell population with a ligand of the CAR molecule chosen from a cognate antigen molecule or an anti-antigen idiotypic antibody molecule that binds to said CAR molecule, under conditions such that immune cell expansion and/or activation occurs, thereby producing an expanded and/or activated immune cell population, and
contacting the expanded and/or activated immune cell population with a nucleic acid encoding a second CAR molecule, wherein the second CAR molecule is stably expressed, thereby producing a second CAR-expressing cell population;
wherein:
(i) the first CAR molecule comprises a CD19 CAR and the ligand comprises a CD19 cognate antigen molecule or an anti-idiotypic CD19 antibody molecule
(ii) the method does not comprise contacting the first CAR-expressing cell population with an agent that stimulates a CD3/TCR complex.

2. The method of claim 1,
wherein providing the first CAR-expressing cell population comprises introducing a nucleic acid encoding a first Chimeric Antigen Receptor (CAR) molecule into the immune cell population, under conditions suitable for transient expression of the CAR molecule, thereby producing a first CAR-expressing cell population, wherein the CAR molecule comprises an antigen binding domain of an antibody molecule.

3. The method of claim 1, wherein the expansion and/or activation of the population of immune cells is carried out in vitro, ex vivo or in vivo.

4. The method of claim 1, wherein:
the population of immune cells is acquired from a blood sample from a subject;
the population of immune cells comprises immune effector cells chosen from T cells, B cells, natural killer (NK) cells, natural killer T (NKT) cells, mast cells, myeloid-derived phagocytes, or a combination thereof;
the population of immune cells comprises primary T cells or a subset of lymphocytes chosen from anergized T cells, naïve T cells, T-regulatory cells, Th-17 cells, stem T cells, or a combination thereof; or
the population of immune cells comprises peripheral blood mononucleated cells (PBMCs), cord blood cells, or a combination thereof.

5. The method of claim 1, wherein the ligand is present on a surface of a cell.

6. The method of claim 1, wherein the nucleic acid encoding the first CAR molecule is an RNA molecule.

7. The method of claim 1, wherein:
the first CAR molecule is transiently expressed in the immune cell population for a finite period of time or number of cell replications;
the first CAR molecule is internalized post a single ligand stimulation;
the immune cell does not receive repeated ligand stimulation;
the level of one or both of: the first CAR-surface density, or the affinity of the CAR antigen binding domain to the ligand is adjusted;
the first CAR-expressing immune cells are cultured in the presence of the ligand of the CAR molecule for about 1, 2, 3, 4, 5, 6, 7, 8, 9, 10, 15, 18, 21, 22, 23 or 24 hours, or about 1, 5, 10, 15, 20, 25, 30, 35, 40, 45 or 50 days;
the first CAR-expressing cells are cultured for a period of 8 days or less;
the first CAR-expressing cells shows at least 3, 4, 5, 6, 7, 8, 9, 10, 11 or 12 or higher population doublings;
the first CAR-expressing immune cell population expands to a total of 400-600, or about 500 cells, wherein the cell expansion is measured between 10 and 25 days after stimulation with the ligand;
the expanded and/or activated immune cell population comprises immune effector cells having a less differentiated phenotype; or
wherein the first CAR-expressing cell population comprises a naïve T cell ($T_N$), a memory stem cell ($T_{SCM}$), a central memory T cell ($T_{CM}$), or a combination thereof.

8. The method of claim 1, wherein the nucleic acid encoding the second CAR molecule is selected from the group consisting of a DNA, an RNA, a plasmid, a lentivirus vector, adenoviral vector, or a retrovirus vector.

9. The method of claim 1, wherein the first and second CAR molecules are directed to the same antigen.

10. The method of claim 1, wherein the first and second CAR molecules are the same or different CAR molecules.

11. The method of claim 1, wherein the second CAR molecule is chosen from a CD19 CAR, a BCMA CAR, a CD33 CAR, a CLL-1 CAR, EGFRvIII CAR, a GFR alpha 4 CAR, an ROR1 CAR, a CD20 CAR, a CD22 CAR, a CD123 CAR, a CD10 CAR, a CD34 CAR, a FLT-3 CAR, a CD79b CAR, a CD179b CAR, a mesothelin CAR or a CD79a CAR, or any combination thereof.

12. The method of claim 1, wherein the immune cell population transiently expressing the first CAR is expanded and/or activated in vitro or ex vivo by contacting said immune cell population with a CD19-antigen or anti-CD19 idiotypic antibody immobilized onto a non-cellular substrate.

13. The method of claim 1, wherein the first and second CAR molecules an CD19 CAR and mesothelin CAR molecules, respectively.

14. The method of claim 1, wherein the population of cells is expanded in the presence of a cytokine chosen from IL2 or IL-15 and IL-7.

15. The method of claim 1, further comprising removing T regulatory cells from the immune cell population, to thereby provide a population of T regulatory-depleted cells.

16. The method of claim 1, further comprising removing cells from the acquired immune effector cell population which express a check point inhibitor chosen from one or mom of PD+ cells, LAG3+ cells, and TIM3+ cells, to thereby provide a population of T regulatory-depleted cells, and check point inhibitor depleted cells.

17. An immune cell preparation or reaction mixture, comprising a population of immune effector cells made according to the method of claim 1, wherein the population of immune cells comprises:
(i) cells that do not have a functional T cell receptor; or
(ii) cells that express a mutated or truncated form of one or more subunit of the TCR.

18. The method of claim 1, wherein the first CAR-expressing population of immune cells comprises cells that do not have a functional T cell receptor.

19. The method of claim 1, wherein the first CAR-expressing population of immune cells comprises cells that express a mutated or truncated form of one or more of a subunit of the TCR.

20. The method of claim 1, wherein the method does not comprise stimulating TCRs on the first CAR-expressing cell population.

21. The method of claim 1, wherein the ligand is attached to a non-naturally occurring substrate.

22. The method of claim 1, wherein the method does not comprise contacting the first CAR-expressing cell population with an anti-CD3 antibody or an anti-CD28 antibody.

23. The method of claim 1, wherein the anti-idiotypic CD19 antibody molecule comprises the same CDRs as the CD19-specific CAR mAb clone no. 136.20.1.

24. The method of claim 1, wherein the anti-idiotypic CD19 antibody molecule comprises the CD19-specific CAR mAb clone no. 136.20.1.

25. The method of claim 1, wherein the CD19 CAR comprises an antigen binding domain comprising a heavy chain complementarity determining region 1 (HCDR1) of SEQ ID NO: 122, a heavy chain complementarity determining region 2 (HCDR2) of SEQ ID NO: 123, 124, 125, or 126, a heavy chain complementarity determining region 3 (HCDR3) of SEQ ID NO: 127, a light chain complementarity determining region 1 (LCDR1) of SEQ ID NO: 128, a light chain complementarity determining region 2 (LCDR2) of SEQ ID NO: 129, and a light chain complementarity determining region 3 (LCDR3) of SEQ ID NO: 130.

26. The method of claim 1, wherein the nucleic acid encoding the second CAR molecule enables stable expression of the second CAR molecule.

27. The method of claim 1, wherein the ligand of the CAR molecule is a CD19 cognate antigen molecule.

28. The method of claim 1, wherein ligand of the CAR molecule is an anti-idiotypic CD19 antibody molecule.

* * * * *